United States Patent 11,446,398 (REGULATED BIOCIRCUIT SYSTEMS) - sequence listing, part 26

SEQ ID NO: 107462 - DNA, 2743 bp, Homo sapiens
  Payload ID: 1092
  Gene Symbol: ASB2
  Gene Name: ankyrin repeat and SOCS box containing 2
  Uniprot ID: Q96Q27
  ENST ID: ENST00000315988
  CDS Start-End: 490-2253
aggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtga

SEQ ID NO: 107463 - DNA, 1911 bp, Homo sapiens
  Payload ID: 1092
  Gene Symbol: ASB2
  Gene Name: ankyrin repeat and SOCS box containing 2
  ENST ID: ENST00000555507
  CDS Start-End: 468-1911
agctggggtccctttggagacactccaggaaaaggggggcacatacccccactgggcttttcctgatgctgacaggggctgctctggctgttcctaagtggaactcgtcaaggtggcagtgacggtgctgatggggacctcaggacttatctgatcagtttcccatcgtccttgctgggtctgttgcttcaccggcatctgtgctctgacaccattaataaccacagagtctgagagtcaggaggaagtgctgctcacgctggaggaagtggctgggagagtgcaggggctggtggcagagaccgcccagagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactggg

SEQ ID NO: 107464 - DNA, 576 bp, Homo sapiens
  Payload ID: 1092
  Gene Symbol: ASB2
  Gene Name: ankyrin repeat and SOCS box containing 2
  ENST ID: ENST00000557613
  CDS Start-End: 210-576
aaaagatttccagccagccctgcaggtgaggaggggctatggaggattccccctgccctgcctgagccttcccgctctgctgcctggagttaaagcctccagaaccccctgtgtcttctgccactaaggaaccaagggttttctgatttgctgttccctcctccccactgggtgtctgttctggaggccagggtgagaggtggaggaggatggccacgcagatcagcactcggggcagccagtgtaccattgggcaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgc

SEQ ID NO: 107465 - DNA, 2842 bp, Homo sapiens
  Payload ID: 1092
  Gene Symbol: ASB2
  Gene Name: ankyrin repeat and SOCS box containing 2
  Uniprot ID: Q96Q27
  ENST ID: ENST00000555019
  CDS Start-End: 432-2339
acaaatgatgacatcacgtgagggccaaagctccgggatcctctctgaagtgagagtctgtattcgatgcacccggaggaacggaaggcaggattgcagcttcctcagtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacagggttttctgatttgctgttccctcctccccactgggtgtctgttctggaggccagggtgagaggtggaggaggatggccacgcagatcagcactcggggcagccagtgtaccattgggcaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgacacctgcccagtg

SEQ ID NO: 107466 - DNA, 661 bp, Homo sapiens
  Payload ID: 1092
  Gene Symbol: ASB2
  Gene Name: ankyrin repeat and SOCS box containing 2
  ENST ID: ENST00000555287
  CDS Start-End: 327-661
ccggaggaacggaaggcaggattgcagcttcctcagtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagc

SEQ ID NO: 107467 - DNA, 566 bp, Homo sapiens
  Payload ID: 1092
  Gene Symbol: ASB2
  Gene Name: ankyrin repeat and SOCS box containing 2
  ENST ID: ENST00000556062
  CDS Start-End: 160-566
agagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcctgcgagcgcaagaacgcggaggccgtgaagattctggtgcagcacaatgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttctt

SEQ ID NO: 107468 - DNA, 2842 bp, Homo sapiens; identical to SEQ ID NO: 107465
  Payload ID: 1092
  Gene Symbol: ASB2
  Gene Name: ankyrin repeat and SOCS box containing 2
  Uniprot ID: Q96Q27
  ENST ID: ENST00000612647
  CDS Start-End: 432-2339

SEQ ID NO: 107469 - DNA, 661 bp, Homo sapiens; identical to SEQ ID NO: 107466
  Payload ID: 1092
  Gene Symbol: ASB2
  Gene Name: ankyrin repeat and SOCS box containing 2
  ENST ID: ENST00000628500
  CDS Start-End: 327-661

SEQ ID NO: 107470 - DNA, 1911 bp, Homo sapiens; identical to SEQ ID NO: 107463
  Payload ID: 1092
  Gene Symbol: ASB2
  Gene Name: ankyrin repeat and SOCS box containing 2
  ENST ID: ENST00000626296
  CDS Start-End: 468-1911

SEQ ID NO: 107471 - DNA, 576 bp, Homo sapiens; identical to SEQ ID NO: 107464
  Payload ID: 1092
  Gene Symbol: ASB2
  Gene Name: ankyrin repeat and SOCS box containing 2
  ENST ID: ENST00000625949
  CDS Start-End: 210-576

SEQ ID NO: 107472 - DNA, 2743 bp, Homo sapiens; identical to SEQ ID NO: 107462
  Payload ID: 1092
  Gene Symbol: ASB2
  Gene Name: ankyrin repeat and SOCS box containing 2
  Uniprot ID: Q96Q27
  ENST ID: ENST00000629617
  CDS Start-End: 490-2253

SEQ ID NO: 107473 - DNA, 566 bp, Homo sapiens; identical to SEQ ID NO: 107467
  Payload ID: 1092
  Gene Symbol: ASB2
  Gene Name: ankyrin repeat and SOCS box containing 2
  ENST ID: ENST00000626017
  CDS Start-End: 160-566

SEQ ID NO: 107474 - DNA, 2214 bp, Homo sapiens
  Payload ID: 1093
  Gene Symbol: ASB3
  Gene Name: ankyrin repeat and SOCS box containing 3
  Uniprot ID: Q9Y575
  ENST ID: ENST00000263634
  CDS Start-End: 136-1692
gtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcct

SEQ ID NO: 107475 - DNA, 1734 bp, Homo sapiens
  Payload ID: 1093
  Gene Symbol: ASB3
  Gene Name: ankyrin repeat and SOCS box containing 3
  ENST ID: ENST00000394717
  CDS Start-End: 213-1550
agacgacatatcaacatccgggggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 107476 - DNA, 2205 bp, Homo sapiens
  Payload ID: 1093
  Gene Symbol: ASB3
  Gene Name: ankyrin repeat and SOCS box containing 3
  ENST ID: ENST00000406687
  CDS Start-End: 684-2021
gcgtctctcgttttcggacggctgcagcatcgcggtggggatcgaaagcgggggcttctgggacgcagctctggagacgcggcctcggaccagccatttcggtgtagaagtggcagcacggcaggtcggtgagtctcggaggcggcagccgcttcctgaagccattcccgctgctctccagtgggcaggcagaggtttgacccacacggagtgatagcgggaagaagacagtgtgaaccgtgcgggtgcgggtccttagatgagaaaattcgaagtagcgatgagatgtgagaaatggcggtgttcctgactgacctgccttcttgcagcttttcttctttttctccgcatttggcatttgtacacttcatttttcccgcttgaggcttatctccatctcttctgctgtggaccgtggccatctcgttacttaacagcttctgactaacgcagggcagtttgttcagcgactgcaactctgtgttaggggaaacctggggtgaggtagcccgccatctccccgtaggtgaataccgcaagcctccgaatttggcgtggtgggcgactctcgtggaatgggcagctagacatcacaaccctacatttttaccctccatctctagattgaagtgttggggtgttgttttatcaaggaagctgattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagt

SEQ ID NO: 107477 - DNA, 2648 bp, Homo sapiens
  Payload ID: 1093
  Gene Symbol: ASB3
  Gene Name: ankyrin repeat and SOCS box containing 3
  ENST ID: ENST00000406053
  CDS Start-End: 1-1432
ggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgaacaaggcttcattctgcaaaaatatctgggaccttcaaattcacaagtggattttctgctcaggggagagctaccaatcggttgaaaggtttctcttccatatgcagaaaactgaaactggacctcttccttacaccttatacaaaaattagctcaagatggattaaagatttaaatgtaagacctaaaaccataaaaaccctagaagaaaacctaggcaatatcattcagtacataggcatgggcaaagacttcatgactaaaacaccaaaagcaattgcaacaaaagccaaaactgacaaatgggatctaattaaattaacaagcttctgcacagcaaaagaaactatcatcagagtgaacaggcaacctacagaatgggagaaaagtttctcaatctatccatctgacaaacggctactatccagaatctacaaggaacttaaacaaatttacaagaaaaaacaaacaaccccatcaaaaagtgggcaaaggatatgaacagacacgaacatctatgcagccaacagacacatgaaaaaatggtcatcatcactggtcatcagagaaatgcaaatcaaaaccacaatgagataccatctcacaccagttagaatggcaatcattaaaaagtcaggaaacaacagatgctggagaggatgtggagaaataggaatgcttttacactgttggtgggagtgtaattacttcaaccattgtggaagacagtgtggcaattccttaaggatctagaaccagaaataccatttgacccagcaatcccattactgggtatatacccaaaggattataaatcattctactataaagacacaagcacacgtatgtttactgaagcactattcacaatagcaaagactttgaaccaagccaaatacccattaatgattgactggataaagaaaatgtggcacatatacaccatggaatactatgcagccataaaaaagaatgagttcatgtcctttgcagggacatggatgaagctggaaaccatcattctcagcaaactaacacaggaacaaaaaaccaaacaccgcatgttctcactcataagtgggagttgaacaatgagaatatatgggcacagggaggggaacatcacacactggggcctgtcattgggtcgggggcaaggggagggatagcattaggagaaatacctaatgtagatgatgggttgatgggtgcagcagaccaccatagcacatgtatacctacgtaacaaacctgcacgttctgcacatgtatcccagaacttgaagtatagtaaaaaaaaa

SEQ ID NO: 107478 - DNA, 3825 bp, Homo sapiens
  Payload ID: 1094
  Gene Symbol: ASB4
  Gene Name: ankyrin repeat and SOCS box containing 4
  Uniprot ID: Q9Y574
  ENST ID: ENST00000325885
  CDS Start-End: 72-1352
cagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagaaatactgggatttttaccactctctctttactgtgtgctgtaactctccaaggactctcatgcacttatcgagatgtgccattagaagaacattacacaacagatgccatagagcaattcctttgctttccctcccattgtcattgaaaaagtacttgcttttagagccagagggaattatttattaagccttatgagacagcagttcccaatcctaggtatttaagtggacttgctgggtagacacagtttgcctaaataaaatggtacttgggttgattataacacttcagggatttcaaaacactttacaaacactgccattaatcctagaatatcatggtatggggaaataaagaagaagtaaagttaaggaattttcaaagacaaggatgtattcagaatgtactgatagaacagtaataactaatatgtatagtgttcttactaagtacctgaaatatttttgtaaaacttcttatatcttatctcatctgaaatgggacccaggttttcttccaaccaatataattctgtgccttatcagtaatatgtttacattctcattcaaatggccatatagcaggctttgcaattggcctcttaaacttggtgttttcccccattaccccttagcagtaattactgtcactagttttgcaaactcctactccccaaaccaagctactcaagtttatttcagtgatgaaggcatatgagcatagtcaaaacaaggagatcttggagtcaaattagaaatgagaaagaaacatcagtccagttaatagtcaagaatggacatttgaaccagacatcactgagccagagactggagatgcaaagatgagtcccatgtgactcctgccttccaggatctcaccatttagcagaggatccagacatacacacagctaactgcaatataaagtgatggggcaagagtacaggtgcagactcacttttaatgcttatctttcaaagttgtgtttctgacatgaagtgtgatttttcttttaagcatgaagttaaagagtgaaggggttatgtaaagtagagggatctcctgctcttgttagggtatttttaaggttttttctagatagtgtgtctttttggtatggtttcttggttagtattaatactttcccagactccttgagaaaaatattgcacactcaatggctccagtgcatgtgacaaggaagcataggaaaatgggggaaagaaagtgtgtgaggggacctagttgattacttcggtctttttatgtagcagactgacatttcatagcattgtagctaagagataaggagcactttgctagtgacagtgggctacgaaaagtaaatagagagactttttgaaaatggtaaaagtttgagaaacttgggaagattagtgtgttaatcaggcttgctagttagtggattgcagaaagaaaaatgtaggtgattaagctctgggccttgtggtttatgaggtcaattttgcttcacttttttttttgttcttgctataatcacttttagataagctcattgctcttagcatcattttttagaggttaaagcagaagtaaattgcaaacaaatctgtcagttgtgagcagatttcttttatgtgtgtggttctccatcatatttaactttggatgctggagtgttgaatagagatgatgtcagatattccaataggctatcatttaatgttaactggcaatcacctaactggttaatctcagttgagactgtgcttctgaactgggattgtcttactcccagggctgtgtaagaaaagtcataggtggatacaataatctcttttaagtatcagttttactcagatattttggtggagatattttgtactaaaacaagatctatatcatggaatagaatgctgaatttgtatgaattattcacataaagcttgatctttcaaaaaatagtttgcttgcagcaagtggtattagaacacatcctaaaacagaatgaaatgatgtcttttgcagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaatcttaaaatagtaataattaacaaagtaaaacaagatcacaccctggaacaattggaggattgcttgctgccctgcatcttaaggcgtattctagcagcaaagcttgtgatgcactgacttggggcaagtaaaactgatgctgaggacaaagggagaagatgttcctcgcccagggaaatgaaaacttttcttattcaccttgcttgtgcttaaacacttatgttcatctagtgtagaatacatggctacttgtttgtaatttttttattggtggaattaaagtaatttttccttatctttgaacttttatttagagaacttaaataaagctcttctgtctcctttc

SEQ ID NO: 107479 - DNA, 1547 bp, Homo sapiens
  Payload ID: 1094
  Gene Symbol: ASB4
  Gene Name: ankyrin repeat and SOCS box containing 4
  Uniprot ID: Q9Y574
  ENST ID: ENST00000428113
  CDS Start-End: 72-1121
cagcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgaggctctgcccagtggtcagcaggttgaggaagattcaaatggcagccttgtctgaaatctccaagtaactcaagcttgcttgaggcttgagtcctgggctaactacctctgatcctctttgaccttccattacatacctaatcctagctgtctcctcatctcatcctagtctaggtttgcttgaaattgggtgtgagagctagaatgagaaaaagagtagcaaataatttgttttgccttgtgtgaacaccagtgcactggtggcttcctgagggactgaggtaagtctgccagaaaggtgaatagtgttagacaggcatacatttgccatcttttaaacagaatgactgatctaaagatgactcagcctgctttgaaattagcttgtagccatgaaagggccacccgattttccagtttaatgaaagctaacgtttattaagtactaaaattatatttattatgtataataaataagcacactgttataagca

SEQ ID NO: 107480 - DNA, 3031 bp, Homo sapiens
  Payload ID: 1095
  Gene Symbol: ASB5
  Gene Name: ankyrin repeat and SOCS box containing 5
  Uniprot ID: Q8WWX0
  ENST ID: ENST00000296525
  CDS Start-End: 115-1104
accagctgatattttctttcctcaggaccagctgttcaggagcatcccggacgagagccaggcacatttgagacttggatccaactaaagaccgccgcagattcttctgcagcaatgtcggtgttagaagaaaatcggccgtttgctcaacaattatccaatgtctactttacaatactttcgctgttctgttttaagctttttgtgaaaatcagccttgccatcctcagtcatttctacatagtgaaaggcaaccgcaaggaagcggcaaggatagcagctgaattttatggagtaacccaaggacaaggttcctgggcagatcgatcaccactacatgaagcagcaagtcaaggtcgccttcttgctctgagaacattattatcacagggttataatgtaaatgcagtaaccttagaccatgtcaccccattgcacgaagcctgccttggagatcacgtggcatgtgccagaactctgctggaagcaggagctaatgtaaatgcaatcacgatagatggcgtgactccgttattcaacgcatgctcccaaggcagtccaagctgtgcagagctgcttctggagtatggtgccaaagcccagctggagtcatgtcttccatccccaacgcatgaggccgccagtaaaggtcaccatgaatgtcttgacatcctgatatcctggggcatagatgttgaccaagaaattcctcatttgggaactcctctctatgtagcttgtatgtcacagcaattccattgcatctggaagcttctttatgctggtgctgacgtacagaaaggcaaatattgggatactccattacatgctgctgctcaacaatccagcacagaaattgtaaacttactgctagaatttggagcagatatcaatgccaaaaatacagagcttctgcgacctatagatgtagctacgtctagcagtatggtggaaaggatattgcttcaacatgaagctaccccaagctctctttaccaactttgccgactctgtatccgaagctacataggaaaaccaagattgcaccttatcccacaactccagctgccaacgttactgaagaatttcttacagtatcgataaaacagtaaagtaattctaaataccttgaaaatcaaaatttctatttcttttgcttaaggaatagttcatataaaaatatgctaaagataggataaaagtgagtgtgagatcacccagggaagcagtaaaatatcaattttcattttaagtgtattagtactattgttttatcatttatgctgtctttggattatagcatatttataatatctattttttgttatttcaatataccctcctgtttattcaggaaaaaataataaagtcactatcttatgttttcttttggattggaaagaaataaagctcctagtaaagttattcatattatatttaaaaaggtctatgttcttcaactaatgggttaactttttaattttggctattgtaattggctaacttgttactgatattgacataaaatatgaatatggcttagcaaagagcaactaatatgttttctgaaaccaggatgatgctcattcaggaaatccactatgttgaatgtccactggtcattagaatgaacacttcataaagataaattgcccccctctcccccacttacccctggcaaaggactcacaagtcacttctcttctccatagtacatggacttgttacagaaaagtgataggatgaaaggtcaatactgccctctcaccctgagatatttagaacattacacaccttctaaggctatgttaagactgcctccttctcaggagtagcccctgatgatctcttatcaaggcggttatatgcatattactccagccttcttccatttcagaaattgtcaatagctagtgatacttggacttaagaaaatgaactatatatctaattaacaaacaggccctggatcatattccggggatcatcacatcagtccaaggatataaaaaaatggaagattaaaaactcaaattgtggagtttttaaagagtgggtgccacttaacacattggagaccttaaaaaatgtatatagagaacttaatcgcactgtttctaattctttttacacaaaacaagggcttagagtatactgtatttgcaagtaatagcaagagagtattgtataaaagaagatattactaagctagtcctctgcaagggtaaatactacgtttattctcttcagctttaactatacttgagtgcaataaaaaacttaataaaattttatgcctgttttgtaattcagggcctattatgattttagaaataagataatcaacgtacaactctttgtaaaacaaaagcaactttgggtgagttttatagatttattaaattttgataaagtaaatattttgaccactattttcaacaacccagggcttattttcttctgacttcttggctaacttccagactatgggaaaataaattatgattgtatgtgacccccagatcactaagcttgcattttggcagaaagaaaaaaaatcagttgtgatttaaaacgtttgttgagattttcaaacatagaaataaagctgtagcatattcactaaacaatgttttatatgaggatagggacctttaaatatgtgttttatagaatatctcacacatttgtaatggataacgtgcattaaaatggagttcttattatagaataacctggttaaacagatattaaagctgcttttgggtaaaacaggtttccaccagtattttccctgagctagaggagaagtcttagattttaagagtaatacaacccatctatcttattagtcttgtgccaataagagaagtaaatatcaaacattaaaatggtcactttacaatttcagtatgtctgtaccttgtatcttagcttgagtatgattgtcttatcaaagtagtgttctaactttaatgtattgtatgtttgttattatattaaagtgtgattattattcattggaataaaa

SEQ ID NO: 107481 - DNA, 1036 bp, Homo sapiens
  Payload ID: 1095
  Gene Symbol: ASB5
  Gene Name: ankyrin repeat and SOCS box containing 5
  Uniprot ID: Q8WWX0
  ENST ID: ENST00000512254
  CDS Start-End: 179-1009
actcactatcactaggccaacagatttaggtactcatgtttaagtaaagtagaataaaaaataaaatggagcaagaactgggctcagatatgactcctaaaggttgtatgagggcacggccttgtaaagaaacccaaagcagcacagcctctgagaactgaataatggccccttccagatgcctctttgcaatggtggaaatttggcagtaacaggttcctgggcagatcgatcaccactacatgaagcagcaagtcaaggtcgccttcttgctctgagaacattattatcacagggttataatgtaaatgcagtaaccttagaccatgtcaccccattgcacgaagcctgccttggagatcacgtggcatgtgccagaactctgctggaagcaggagctaatgtaaatgcaatcacgatagatggcgtgactccgttattcaacgcatgctcccaaggcagtccaagctgtgcagagctgcttctggagtatggtgccaaagcccagctggagtcatgtcttccatccccaacgcatgaggccgccagtaaaggtcaccatgaatgtcttgacatcctgatatcctggggcatagatgttgaccaagaaattcctcatttgggaactcctctctatgtagcttgtatgtcacagcaattccattgcatctggaagcttctttatgctggtgctgacgtacagaaaggcaaatattgggatactccattacatgctgctgctcaacaatccagcacagaaattgtaaacttactgctagaatttggagcagatatcaatgccaaaaatacagagcttctgcgacctatagatgtagctacgtctagcagtatggtggaaaggatattgcttcaacatgaagctaccccaagctctctttaccaactttgccgactctgtatccgaagctacataggaaaaccaagattgcaccttatcccacaactccagctgccaacgttactgaagaatttcttacagtatcgataaaacagtaaagtaattctaaataccttg

SEQ ID NO: 107482 - DNA, 603 bp, Homo sapiens
  Payload ID: 1095
  Gene Symbol: ASB5
  Gene Name: ankyrin repeat and SOCS box containing 5
  ENST ID: ENST00000505299
  CDS Start-End: 544-603
aatgctgaggttggtggacaaataaaggcttcactcgactttttattgatttgacattctggtactagataaaggaaagagcaaaacaaagtgcaggatcgagagaaaatcgattgcttgaaaaactgggtattttacttgctgcaagtcccgactgtgtcagctgatgagtttaacactatgacagcacagtcctcacctgcctgctcgctgctgtaatccccacactgttgtgtgccctatagcacctggcacacgggaagcgctcaagagatgtgtgtgaatgaaggagccacatcttgacttgcgacgcggagcagtaagctgcagttatttggtagcggtggaagaataaattctacctcctgcttgcctcgctgcagtggggatgagggagaggggactcagccagatgctgaattccccagacagctgacaggttcccaatttccaggaccagctgttcaggagcatcccggacgagagccaggcacatttgagacttggatccaactaaagaccgccgcagattcttctgcagcaatgtcggtgttagaagaaaatcggccgtttgctcaacaattatccaatgtctactttaca

SEQ ID NO: 107483 - DNA, 2330 bp, Homo sapiens
  Payload ID: 1096
  Gene Symbol: ASB6
  Gene Name: ankyrin repeat and SOCS box containing 6
  Uniprot ID: Q9NWX5
  ENST ID: ENST00000277458
  CDS Start-End: 167-1432
cttccggcgggggcgcggcttggactgaggagcggacccggccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaa

SEQ ID NO: 107484 - DNA, 2180 bp, Homo sapiens
  Payload ID: 1096
  Gene Symbol: ASB6
  Gene Name: ankyrin repeat and SOCS box containing 6
  Uniprot ID: Q9NWX5
  ENST ID: ENST00000277459
  CDS Start-End: 126-719
ccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccgggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaa

SEQ ID NO: 107485 - DNA, 4535 bp, Homo sapiens
  Payload ID: 1096
  Gene Symbol: ASB6
  Gene Name: ankyrin repeat and SOCS box containing 6
  ENST ID: ENST00000450050
  CDS Start-End: 171-1349
gtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaacaaggtccttatataaaatttccaccccgcccctccatagttcaggatagaggctcccacagcagccggtaaggaagtgggtggcaggtgtgaggggatgctgtgtttggggggttgtttccaagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctcacctcactgcaagctctgcctcccgggctcaccccattctcctgcctcagcctcctgagtagctgggactacaggcgcccgccatcacgcctggctaattttttttttttttgtattttaagtagagacggggtttcacctgttagccaggatggtctcaatctcctgacctcgtgatctgcccgcctcggcctcccaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggctaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactcc

SEQ ID NO: 107486 - DNA, 4985 bp, Homo sapiens
  Payload ID: 1097
  Gene Symbol: ASB7
  Gene Name: ankyrin repeat and SOCS box containing 7
  Uniprot ID: Q9H672
  ENST ID: ENST00000332783
  CDS Start-End: 786-1742
aggctcaggctccactgcgggcgctgattggttgttgaaggcttggtcccatcccagtgaccccaaagtgctgaagggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggagctgatcctacagttaaagacttaatcggaggcttcacggctcttcactatgcagccatgcatggccgggcccgcattgcacgcttgatgttagaatctgaatacaggagcgacatcattaatgcaaaaagcaatgacggctggactcccctccatgtggctgcccactacggcagggactcatttgtccggctcctcctggagttcaaggctgaggttgacccactcagtgataaaggtaccacaccgcttcagctcgccattatccgagagaggtcaagctgtgtgaaaatcctcctggaccacaatgccaacatcgacattcagaatggtttcctgttgcgatacgccgtgatcaaaagcaatcactcttattgccgaatgttccttcagagaggggcagacacaaacttgggtcgcttagaagacggacagactcctttacacttatctgcccttagggatgatgtgctgtgtgcacggatgttatataattacggagcagacacgaacacacggaactatgaaggacagaccccattggctgtttcaataagtatttctggaagtagtcgaccatgtttggatttcttacaagaagtcacaagacagcccagaaacttgcaggacctgtgccgaattaaaattcgacaatgtataggccttcaaaacctaaagctacttgatgaactaccaattgccaaggtcatgaaagactacttaaaacacaaatttgatgatatctgatatgccagaactgtgagcaagattaggagttctattctagatacttaaaaggctttttgccttgcacaaagtatatcctatgcaatttctgatttgctgtgaaatcagaaagcaggtatacacttttgggttttctgtttgtttggttggttttcattgtaggggagggattttttatatatatataaaaacacacaccacatgcttgaaggtcttaatttggtttcttggtccaagtttaagaggtccaagctttgtatacaatactgcatttagaaaaattgtcttttcttaaatgacacaagcaggtttagagtggagaatttaccctttccaaatttatggttccttggtaagcacggtattctaaaccagcagagcacttgttaacgtttggaggcacagtttcacccagggcgaccctgggttcttttggaaaatgccctaagaaatgtttgaagtaacgctgtcacctcattcatttttaatgagtacaaactggccgtttcaaactgttctttttcctaattaatgtagctttcggatgacataaatccagtatctctgcttatgacataaatccagtacctctgcttttcttttgctgtgctcttgtttttaacttattttttttttaacaactgtagtacactaccctgagacactgcatctcgatttctatctctagttagagttgtacttttaaaaaaattaacgggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaactttttaagcgtaaaatctttaaggggtacacatttataagtctggctaatttctaatatgctaattaaacatttcccattttaaggttatatacagtgaggctcttcaggacaattattttctgggttgattgggcatatgtttgccgtgtaaacacggatatgataaagtgtcagtaacaatggaaaaggtcccagaggcattaggcatctaagaggatgccctcagaaacgtattctggcttgatttgtgttattaacttcagaagaaccttttcaaatgtcccagtatcgttcttagtgctttgggaaaaaatatttaacacactgttaataaatttgttatcagaagtttacaagacgaagggcttctctcgtctgaatttctagatttaagtcatgaagtgtaaaactgtttcacccagaagtgtaactaagcagaactaggagttttctctggcttcacctttttcagagccagcagtgctgttttctcaagcacagcgtttgctcttagactctgatctgcttgtgcctaagcattgcacaggtttccgaagacgggcagcttcagagaagaggattattcgggagattgctggtgtggcccatagactctttggcatagactctttcgcaggcagccactctgagtgtggccagttctataaccatccccaaactagctggagcctgatggataggaacgggtagtctgtcctcttccccataaaaatgttccaaaaagttatctccagagagagtcccttatgaagacagttgccaagctgtattctcattctttaaaccaatacccaggtcagggctagttcacactagcactgttagggacatggtgtggctagaaatgaattgagtgtgacttctccctacaaccccaggcccagggataggaggaggcagaggggtgcctggagtttctgcactctcatcagtgatgttcatgttacacttgcacaagggctgatttccacgtatgtgtgtgttaatttattcacttagtttcaaaagattttctctccccagccattcagaggtttccaaactaagccactgagtttgagtcagggaattccacgtaaaaagatcagattaaggtaaattctttgttctgtattgctgctgtgacttcagaaaaaaaaaattatgagagctcttcctggaattttgaaatttctatttaatgaagaagtgtataattccattatttattgtttgaggtttgatttatctggaagcttaaaaagaatgttttatttttgttgttaataaaatcccaatcacatttcacaataactaaaatgtctccaggtgggttactggtagatgatagtggtgacacctgcaggtctgcatttgaattggattcacagagaagcattccatggtcacataatgaatagggagaacagatattttcagaaaaatcaaccgattgttttttccagaaacagaacagaaaatgttcagaatattttcaaatttgtcagattcttttatgtttcctttgaaatttattatttaagcctattactaaacctttataaaaatatatttggcaaatacaccaaagaaaccagcttacaaaagattatgatcattaatgaactgcaaacctcatctttcgaaaacaaggttttgtgtttttttttttttgtaaatatttgtgtttataaatgtacagcagagtaagagtgttttttagattatttaattcccatatttctaaactatttactacacagtaatccatgcctgttagtttggaggacttgactgtctcattttttaattcattgtcagtcatgcttggaacagcatttccactagagaatccagcgttctggcagtagcaagagtacacatctggagcatgagggactctagcatgactcgtcagatgcacaccccaagagacaagaatgtgtagtttaatgaccggcgtggaccatacgaaattgagattctaactttcctgcaggagtgctcatgagcccagaatgtgattgggataaggccatttgcccacaaatttagctttcatgtaactcctagtgtgttatatcataatgtattttgttcttcctttttaatgtaagttttgctttgggtcaatttgaattaaaaaaatcaaatctgatttaaaacatg

SEQ ID NO: 107487 - DNA, 1694 bp, Homo sapiens
  Payload ID: 1097
  Gene Symbol: ASB7
  Gene Name: ankyrin repeat and SOCS box containing 7
  Uniprot ID: Q9H672
  ENST ID: ENST00000343276
  CDS Start-End: 711-1535
gggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggagctgatcctacagttaaagacttaatcggaggcttcacggctcttcactatgcagccatgcatggccgggcccgcattgcacgcttgatgttagaatctgaatacaggagcgacatcattaatgcaaaaagcaatgacggctggactcccctccatgtggctgcccactacggcagggactcatttgtccggctcctcctggagttcaaggctgaggttgacccactcagtgataaaggtaccacaccgcttcagctcgccattatccgagagaggtcaagctgtgtgaaaatcctcctggaccacaatgccaacatcgacattcagaatggtttcctgttgcgatacgccgtgatcaaaagcaatcactcttattgccgaatgttccttcagagaggggcagacacaaacttgggtcgcttagaagacggacagactcctttacacttatctgcccttagggatgatgtgctgtgtgcacggatgttatataattacggagcagacacgaacacacggaactatgaaggacagaccccattggctgtttcaataagtatttctggaagtagtcgaccatgtttggatttcttacaagaagtcacaagtatgtaatataattattactttattgcattttttaaaaatttgcatcttctgaggagcttaatgtgtttttgcaacttaagatgactagatattaatcattcctataaccactgcttggtaagcgatgcctcattcttctgaaataaaaaaaaaactttgactgta

SEQ ID NO: 107488 - DNA, 2133 bp, Homo sapiens
  Payload ID: 1097
  Gene Symbol: ASB7
  Gene Name: ankyrin repeat and SOCS box containing 7
  ENST ID: ENST00000558747
  CDS Start-End: 712-1062
agggagggggcgggggtggcccagtgcaaagtgcatcccgaaagccccctgtccggagaccccacggctggcacttcgggccccgtatgacctgggacctcgccgtcccgagacctcctgggtccctccgtagctggaagcctccggcccggagcgcggcagccccctgctccgagccctggaccgggactgcccccccacccgagccaggacttcctccctgcctccctgcacctctgccccaaggctgcccggcggccgggatcgccacctcctgccttctcggctgttcggatgttcgccgggctggggccgtgaggcaccgaggaggatcaggaacaccagggtccggccctgcctggggtatttcttcaatggagaagttggtgagtgtagaggaggctgaaaggaggaagagaagcagcagctgaggagacaggtttgagctggctgaagaagacgcgaaagcaggaagaggtctgcccacctatcagagaagcagaaggcacagtgcctctgaccagcatcgtctgtaaaggttaagaaggcttttttgctctgtagcctggacgtactttgaagcccctccccacgatgctgtacgtgcacaatggttactaggcaatccgtacatcaggagaagggacactcttccataaggctgatccccgtaacctaatgaatcctttgtaaaaagtggactcagctaggatgttacaccatcattgtcgaaggaaccctgagctccaggaagagttgcagattcaggccgcggtggctgctggggatgtccacacagtgcgaaagatgctagaacaaggctattccccgaatggccgagatgcgaatggctggactctgcttcatttctctgcagcaagaggaaaggaaagatgtgttcgggtttttctagaacacggaggacagcccagaaacttgcaggacctgtgccgaattaaaattcgacaatgtataggccttcaaaacctaaagctacttgatgaactaccaattgccaaggtcatgaaagactacttaaaacacaaatttgatgatatctgatatgccagaactgtgagcaagattaggagttctattctagatacttaaaaggctttttgccttgcacaaagtatatcctatgcaatttctgatttgctgtgaaatcagaaagcaggtatacacttttgggttttctgtttgtttggttggttttcattgtaggggagggattttttatatatatataaaaacacacaccacatgcttgaaggtcttaatttggtttcttggtccaagtttaagaggtccaagctttgtatacaatactgcatttagaaaaattgtcttttcttaaatgacacaagcaggtttagagtggagaatttaccctttccaaatttatggttccttggtaagcacggtattctaaaccagcagagcacttgttaacgtttggaggcacagtttcacccagggcgaccctgggttcttttggaaaatgccctaagaaatgtttgaagtaacgctgtcacctcattcatttttaatgagtacaaactggccgtttcaaactgttctttttcctaattaatgtagctttcggatgacataaatccagtatctctgcttatgacataaatccagtacctctgcttttcttttgctgtgctcttgtttttaacttattttttttttaacaactgtagtacactaccctgagacactgcatctcgatttctatctctagttagagttgtacttttaaaaaaattaacgggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaa

SEQ ID NO: 107489 - DNA, 2615 bp, Homo sapiens
  Payload ID: 1098
  Gene Symbol: ASB8
  Gene Name: ankyrin repeat and SOCS box containing 8
  Uniprot ID: Q9H765
  ENST ID: ENST00000317697
  CDS Start-End: 171-1037
gaacactcatcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaaaaaaaaaccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaag

SEQ ID NO: 107490 - DNA, 659 bp, Homo sapiens
  Payload ID: 1098
  Gene Symbol: ASB8
  Gene Name: ankyrin repeat and SOCS box containing 8
  ENST ID: ENST00000540782
  CDS Start-End: 141-401
atcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtaatgtttttaacacattcacattaatgactcactaaaacttgagcttcatgttttcttagaatttctccccatcactcctccatctcttccctcctccagtctgaacttctaactcaaggtaatgttggcatagccaatattaaggaaaatgtaatggtaaatatataaaatgatctaaggatttcattcttttacctttctgtccccaccctgcttgcccccattgtatggtgctgatactctgcctttctttcttctccttaacttaagctgtcactggcc

SEQ ID NO: 107491 - DNA, 570 bp, Homo sapiens
  Payload ID: 1098
  Gene Symbol: ASB8
  Gene Name: ankyrin repeat and SOCS box containing 8
  ENST ID: ENST00000545791
  CDS Start-End: 229-570
ctgcttccgggtcacgccttgacagcggctttcaacccccacctcagcccagcaattcgtaccggacctaccgggattgctgcgatctgtttagagcccgtgcagaaagtgacaccgcacgtccttgcgtttcgtgcccttgccccccgccccctagcctcagcgagacagctgccgcgggccctcccgcagcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttg

SEQ ID NO: 107492 - DNA, 538 bp, Homo sapiens
  Payload ID: 1098
  Gene Symbol: ASB8
  Gene Name: ankyrin repeat and SOCS box containing 8
  ENST ID: ENST00000539865
  CDS Start-End: 53-250
acctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataagggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctg

SEQ ID NO: 107493 - DNA, 923 bp, Homo sapiens
  Payload ID: 1098
  Gene Symbol: ASB8
  Gene Name: ankyrin repeat and SOCS box containing 8
  ENST ID: ENST00000536953
  CDS Start-End: 166-423
ctcatcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggactccctgggagttgcttgctgaccctcctgttcagagcactgcatagcaaaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgca

SEQ ID NO: 107494 - DNA, 580 bp, Homo sapiens
  Payload ID: 1098
  Gene Symbol: ASB8
  Gene Name: ankyrin repeat and SOCS box containing 8
  ENST ID: ENST00000539464
  CDS Start-End: 167-367
actcatcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataaggtttccagtgctttgatacataagattgtcttcagtgatgtccagggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctat

SEQ ID NO: 107495 - DNA, 657 bp, Homo sapiens
  Payload ID: 1098
  Gene Symbol: ASB8
  Gene Name: ankyrin repeat and SOCS box containing 8
  ENST ID: ENST00000535055
  CDS Start-End: 163-420
actcatcagtgcgcaggcgcccatcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggactccctgggagttgcttgctgaccctcctgttcagagcactgcatagcaaaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctg

SEQ ID NO: 107496 - DNA, 561 bp, Homo sapiens
  Payload ID: 1098
  Gene Symbol: ASB8
  Gene Name: ankyrin repeat and SOCS box containing 8
  ENST ID: ENST00000540212
  CDS Start-End: 225-561
aattcggtgagtgcggtccttggagtgggtctacagccaggtttcctaacccaggtaccggacctaccgggattgctgcgatctgtttagagcccgtgcagaaagtgacaccgcacgtccttgcgtttcgtgcccttgccccccgccccctagcctcagcgagacagctgccgcgggccctcccgcagcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatg

SEQ ID NO: 107497 - DNA, 568 bp, Homo sapiens
  Payload ID: 1098
  Gene Symbol: ASB8
  Gene Name: ankyrin repeat and SOCS box containing 8
  ENST ID: ENST00000536071
  CDS Start-End: 91-378
gcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgagctcctgtcatatcttcatctttatcaccaggactccctgggagttgcttgctgaccctcctgttcagagcactgcatagcaaaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctg

SEQ ID NO: 107498 - DNA, 679 bp, Homo sapiens
  Payload ID: 1098
  Gene Symbol: ASB8
  Gene Name: ankyrin repeat and SOCS box containing 8
  ENST ID: ENST00000535988
  CDS Start-End: 163-423
atcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtaatgtttttaacacattcacattaatgactcactaaaacttgagcttcatgttttcttagaatttctccccatcactcctccatctcttccctcctccagtctgaacttctaactcaaggtaatgttggcatagccaatattaaggaaaatgtaatggtaaatatataaaatgatctaaggatttcattcttttacctttctgtccccaccctgcttgcccccattgtatggtgctgatactctgcctttctttcttctccttaacttaagctgtcactgg

SEQ ID NO: 107499 - DNA, 559 bp, Homo sapiens
  Payload ID: 1098
  Gene Symbol: ASB8
  Gene Name: ankyrin repeat and SOCS box containing 8
  ENST ID: ENST00000540143
  CDS Start-End: 87-287
gcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataaggtttccagtgctttgatacataagattgtcttcagtgatgtccagggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgg

SEQ ID NO: 107500 - DNA, 800 bp, Homo sapiens
  Payload ID: 1098
  Gene Symbol: ASB8
  Gene Name: ankyrin repeat and SOCS box containing 8
  ENST ID: ENST00000539503
  CDS Start-End: 419-800
gaaattattggagaagcacaaaaggccatgggaaacatgtgcagagatcaagcagtttggctggtccagtcaagttccaggtcaaacatttgagagccaagggaccaagacccgaaccctgcggctgtggccgagaacgctgcactgagcctgcgcgcaaagcctctgagtaaaaggagaaagtaaccccctaactaggcctctggagggcgaaagctgctgcacaagtctgcgcaggcgcgccccgctgacgaacactcatcagtgcgcaggcgcccatcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagccttta

SEQ ID NO: 107501 - DNA, 839 bp, Homo sapiens
  Payload ID: 1098
  Gene Symbol: ASB8
  Gene Name: ankyrin repeat and SOCS box containing 8
  ENST ID: ENST00000539528
  CDS Start-End: 74-331
gccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggactccctgggagttgcttgctgaccctcctgttcagagcactgcatagcaaaggtagtgggtaaccatgcaagcttctttgctgctgtcctgtcttcctctcagtagtctgtctactgtaatagttcctccctttttacaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgcttt

SEQ ID NO: 107502 - DNA, 2610 bp, Homo sapiens
  Payload ID: 1098
  Gene Symbol: ASB8
  Gene Name: ankyrin repeat and SOCS box containing 8
  Uniprot ID: Q9H765
  ENST ID: ENST00000536549
  CDS Start-End: 167-1033
gaacactcatcagtgcgcaggcgcccatcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaaaaaaaaaccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaa

SEQ ID NO: 107503 - DNA, 582 bp, Homo sapiens
  Payload ID: 1098
  Gene Symbol: ASB8
  Gene Name: ankyrin repeat and SOCS box containing 8
  ENST ID: ENST00000548228
  CDS Start-End: 430-582
tatattgcaaggcccagtgttataaataacttaatggtggtgctgatcataaaaaccacaaaaattcaaagaaggaaaataatgttttttgacctcttcagccttttaaaaatcctattccttgcctagtcgtttgtaaaccacacagagctccacgggggtcttagtacctcttggggaaatctcgtgctagactaggttagagtagaacatttgtgtccaggtttatccaactccctaggcaactattataatccaattccttatgattatggaaatagtattaatcactccttgaaatctgcttttagcattgggaaggcctcagagaagacctaaccctaaagacaggtgtgctcagtgatattgtatatgccgaaaacttctttgtttcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcat

SEQ ID NO: 107504 - DNA, 278 bp, Homo sapiens
  Payload ID: 1098
  Gene Symbol: ASB8
  Gene Name: ankyrin repeat and SOCS box containing 8
  ENST ID: ENST00000629941
  CDS Start-End: 78-278
gccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataaggtttccagtgctttga

SEQ ID NO: 107505 - DNA, 1612 bp, Homo sapiens
  Payload ID: 1099
  Gene Symbol: ASB9
  Gene Name: ankyrin repeat and SOCS box containing 9
  Uniprot ID: Q96DX5
  ENST ID: ENST00000380483
  CDS Start-End: 178-936
gtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 107506 - DNA, 1652 bp, Homo sapiens
  Payload ID: 1099
  Gene Symbol: ASB9
  Gene Name: ankyrin repeat and SOCS box containing 9
  Uniprot ID: Q96DX5
  ENST ID: ENST00000380485
  CDS Start-End: 188-976
ctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 107507 - DNA, 1678 bp, Homo sapiens
  Payload ID: 1099
  Gene Symbol: ASB9
  Gene Name: ankyrin repeat and SOCS box containing 9
  Uniprot ID: Q96DX5
  ENST ID: ENST00000380488
  CDS Start-End: 275-1159
gtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaa

SEQ ID NO: 107508 - DNA, 1947 bp, Homo sapiens
  Payload ID: 1099
  Gene Symbol: ASB9
  Gene Name: ankyrin repeat and SOCS box containing 9
  Uniprot ID: Q96DX5
  ENST ID: ENST00000546332
  CDS Start-End: 485-1273
gtacagatggccagggcgtgctgtgcatgttactgtgcaagcaattcagcagggctgctgcaaaaccagctttctcagctctgggtgctcgggcttgtctccataacaagctaccatgtaacaaacggatctcagcagggtgaacaacagttgcagaaagtgagctgtttccttcacccccaccctgctcccttcactctcaaaagttacaaactgagtttccttcctgataaactccaaggcttcctcactgattggtctcagtttgggaaaggacgtgacatcagcaacttcgcagacttagggctggagggttcttgtggcctctggcgggcctccagccagttagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtct

SEQ ID NO: 107509 - DNA, 633 bp, Homo sapiens
  Payload ID: 1099
  Gene Symbol: ASB9
  Gene Name: ankyrin repeat and SOCS box containing 9
  ENST ID: ENST00000477346
  CDS Start-End: 1-633
tgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaagacggagtcacgctctgtcgcccaggttggagtgcagtggcgcgatctcggctcattgcaacctccgcctcccggaattcagataagatgtgttccccaggccagcagtccttcatgctgcttgtca

SEQ ID NO: 107510 - DNA, 6347 bp, Homo sapiens
  Payload ID: 1100
  Gene Symbol: ANKS1A
  Gene Name: ankyrin repeat and sterile alpha motif domain containing 1A
  Uniprot ID: Q92625
  ENST ID: ENST00000360359
  CDS Start-End: 139-3543
tcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaagaaagtggtgttggtggatggaaaaacaaaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgagattgagaaaatcatgagttctattggagaagggattgacttttctcaggaacggcagaagatctcaggtttacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccgagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgcagccttaa

SEQ ID NO: 107511 - DNA, 1675 bp, Homo sapiens
  Payload ID: 1101
  Gene Symbol: ANKS1B
  Gene Name: ankyrin repeat and sterile alpha motif domain containing 1B
  ENST ID: ENST00000333732
  CDS Start-End: 467-1336
gggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttcttt

SEQ ID NO: 107512 - DNA, 996 bp, Homo sapiens
  Payload ID: 1101
  Gene Symbol: ANKS1B
  Gene Name: ankyrin repeat and sterile alpha motif domain containing 1B
  ENST ID: ENST00000329257
  CDS Start-End: 1-996
agcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgta

SEQ ID NO: 107513 - DNA, 2115 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000341752
  CDS Start-End: 475-1239
gcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaaggagacataccatttacagaaatttcttttgataaaattaaggtttcacttttcacatttgcttaaatcacagtaagcctgtaaactagctccttgacccaccattt

SEQ ID NO: 107514 - DNA, 2973 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000549025
  CDS Start-End: 135-1208
gggtaatgaaggggagcgagcgagggggagcaaggagcatggagctgcatactgatgagtgacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 107515 - DNA, 1383 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000546960
  CDS Start-End: 1-1383
atgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcctttctgttttaaagcagatcgacccatctga

SEQ ID NO: 107516 - DNA, 3372 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000550693
  CDS Start-End: 255-1607
ctccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 107517 - DNA, 3328 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000549493
  CDS Start-End: 273-1805
attgctcattgtggagtactccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaa

SEQ ID NO: 107518 - DNA, 1281 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000546568
  CDS Start-End: 1-1281
atgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctga

SEQ ID NO: 107519 - DNA, 2595 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000547010
  CDS Start-End: 301-2595
ggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttga

SEQ ID NO: 107520 - DNA, 1937 bp, Homo sapiens
  Payload ID: 1101
  Gene Symbol: ANKS1B
  Gene Name: ankyrin repeat and sterile alpha motif domain containing 1B
  ENST ID: ENST00000550778
  CDS Start-End: 1-1598
tgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttcttt

SEQ ID NO: 107521 - DNA, 2268 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000549558
  CDS Start-End: 255-1499
ctccaacaatcacatagaacgcagaccagcccaagctgacagcttgatatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactaggtatctcttctttcttcatgttaccttgtctttcttcccatttttcttttaagacagggtcttgctatgtcacccaggctggactcaaactccagggctcaaggaatcctcctgtcttagcctcccaaggagctgggattacaggcacgtgccaccgcacctggctcctaatttctttttaagacaagggccattcaaggctttttaaaacctgatgtgtgttgttatactttataacagtcagtggcttttaattccaaaaggtaatactttatactctgcctacatgagatgagcccctaacagtgtgtacaaataaaattatgatttgggtattctaa

SEQ ID NO: 107522 - DNA, 3885 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000547776
  CDS Start-End: 1-3747
atggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacaggaattgatgccaacataaaggatagcttaggtagaactgtcttggacattctgaaagaacatccatctcagaaatctctccagattgcaacactcttacaagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaa

SEQ ID NO: 107523 - DNA, 2105 bp, Homo sapiens
  Payload ID: 1101
  Gene Symbol: ANKS1B
  Gene Name: ankyrin repeat and sterile alpha motif domain containing 1B
  ENST ID: ENST00000549866
  CDS Start-End: 418-2105
ctgcgctcccgctccagctaggactctctctgccgcctcctcctcctcctccgacctcagtcctcaccaccctcctcccgctcctcaaaagcacccccgagtccccaccccctcacgccgcacccgcgggaacgaggccttgggaattcaggggagtggctgtgggggcgcgtcgcggctcccagctcggccagcccctctttcaagacatggtctgatccccattgtaaaagctgcgccccgaagaggaggagagagtcgtgctccctgcctggggctgcagggagctctccgtgctgaagctcttgcattattttagggtggggcgaagagggccctggattttggggagtgggggtgggtggggaggaggacccgaggggggcaaggactctgtgggggagtcggtgagagactatggggaaggaccaggagctgctggaagctgctcgcactggaaatgtggctctggtggagaaactcctgtctggcaggaaaggagggatcctgggcggtggatccggacccctgcccctgtctaatctgctaagcatctggcgaggccccaatgtgaactgcacagacagttcgggttacactgctttacaccacgcagccttaaatggacataaggacatagttctcaaactacttcagtatgaggcatcaacaaatgtagcagacaacaaagggtattttcctattcacctggctgcctggaaaggagatgtggaaattgtgaagattcttattcatcatggaccatcacattccagggtcaatgaacagaacaatgaaaatgaaactgccctacactgtgcagctcaatatggacactcagaagtagttgctgttctcctagaagagctcactgacccgacaattagaaatagcaagctggaaacacctttggacttggcggcactctacggacggcttagagtggtaaaaatgatcatcagtgcacatcctaacttaatgagctgcaacactcgcaagcacacgccacttcaccttgctgcgcgcaatggccacaaagcagtcgtgcaggtgctgctggaggcaggaatggatgtgagctgtcaaacagaaaaggggagtgcacttcatgaagcagctttgtttggaaaggtggatgttgtacgagttctgttagaaacagagtatttagaaggcgtgggaagatctacagtcctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacaatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatccccc

SEQ ID NO: 107524 - DNA, 1690 bp, Homo sapiens
  Payload ID: 1101
  Gene Symbol: ANKS1B
  Gene Name: ankyrin repeat and sterile alpha motif domain containing 1B
  Uniprot ID: Q7Z6G8
  ENST ID: ENST00000547446
  CDS Start-End: 118-1302
gtaacgtataaccagtatgaagattcaattcagatttaagcactttggtttgcttttgaatcttgctattttctgcatttgttttgactgctctcatcattcaagattgacgcttggatgggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaaaagtaaaggggatctctaatactgcct

SEQ ID NO: 107525 - DNA, 838 bp, Homo sapiens
  Payload ID: 1101
  Gene Symbol: ANKS1B
  Gene Name: ankyrin repeat and sterile alpha motif domain containing 1B
  ENST ID: ENST00000555119
  CDS Start-End: 1-157
ctcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaacaaaatcctcctcttgaccgactgcatgaactgccatgaaatttgcagctccatcatactagtggttgaaaaatgaaacaccgcctcataactgggaaaggagcactttcatccaaagacgcgaactcagagcaaaatgaacatttccaaagcagccctgccacttcagctgacacacatttatgtgactggtagagagaaggttggttacttagtcctcaagaagaagaatcttaatttccctggaaagcccatctgataacacctctgttcctgcaaactgtatactctcctagtcttctgcactatatacct

SEQ ID NO: 107526 - DNA, 1297 bp, Homo sapiens
  Payload ID: 1101
  Gene Symbol: ANKS1B
  Gene Name: ankyrin repeat and sterile alpha motif domain containing 1B
  ENST ID: ENST00000547362
  CDS Start-End: 210-533
ttcaggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcggctttctaattttaatttcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtattt

SEQ ID NO: 107527 - DNA, 694 bp, Homo sapiens
  Payload ID: 1101
  Gene Symbol: ANKS1B
  Gene Name: ankyrin repeat and sterile alpha motif domain containing 1B
  ENST ID: ENST00000549797
  CDS Start-End: 410-694
gggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcaggggcgatgcaaggaggagaagaaatgaaaactactttgatgatattccccgatcaaaactggagaggcagatggctcagcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgg

SEQ ID NO: 107528 - DNA, 569 bp, Homo sapiens
  Payload ID: 1101
  Gene Symbol: ANKS1B
  Gene Name: ankyrin repeat and sterile alpha motif domain containing 1B
  ENST ID: ENST00000552407
  CDS Start-End: 281-569
agtgctaggcgccctgcagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggtaa

SEQ ID NO: 107529 - DNA, 489 bp, Homo sapiens
  Payload ID: 1101
  Gene Symbol: ANKS1B
  Gene Name: ankyrin repeat and sterile alpha motif domain containing 1B
  ENST ID: ENST00000552748
  CDS Start-End: 373-489
gagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttg

SEQ ID NO: 107530 - DNA, 460 bp, Homo sapiens
  Payload ID: 1101
  Gene Symbol: ANKS1B
  Gene Name: ankyrin repeat and sterile alpha motif domain containing 1B
  ENST ID: ENST00000551613
  CDS Start-End: 401-460
agtgctaggcgccctgcagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcaggcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgg

SEQ ID NO: 107531 - DNA, 418 bp, Homo sapiens
  Payload ID: 1101
  Gene Symbol: ANKS1B
  Gene Name: ankyrin repeat and sterile alpha motif domain containing 1B
  ENST ID: ENST00000548447
  CDS Start-End: 336-418
agcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctca

SEQ ID NO: 107532 - DNA, 779 bp, Homo sapiens
  Payload ID: 1101
  Gene Symbol: ANKS1B
  Gene Name: ankyrin repeat and sterile alpha motif domain containing 1B
  ENST ID: ENST00000546364
  CDS Start-End: 327-779
tatccatagtaaccgaggatgcgaggggcgcccagcagcagcgagtgcctgggagccaggaggagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcggggaaaagaaaagtctacagagcaaatgaagaaggtccctactattattctttctgtctcatataaaggagtcaaatttattgatgcaacaaataag

SEQ ID NO: 107533 - DNA, 574 bp, Homo sapiens
  Payload ID: 1101
  Gene Symbol: ANKS1B
  Gene Name: ankyrin repeat and sterile alpha motif domain containing 1B
  ENST ID: ENST00000551560
  CDS Start-End: 383-574
agtcgcggtgctgcttatgtgcgccgggcacgttggatcagtagattagagacacgggaactttggaattgcttgatgattcttagacacttataaggatacttgctctgtggactcctgcatctggaaagggaaaactacaggaaatagtgttggaatggcaacatgaggaatttaggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagtcgtctgtctgtgaaatatggacgaatcagaacgcaggatttcctttctcagcgatccatcaggttcataatacaggagactggggagaaccttccattaccttgcga

SEQ ID NO: 107534 - DNA, 2662 bp, Homo sapiens
  Payload ID: 1102
  Gene Symbol: ANKS3
  Gene Name: ankyrin repeat and sterile alpha motif domain containing 3
  Uniprot ID: Q6ZW76
  ENST ID: ENST00000304283
  CDS Start-End: 296-2266
agcacaggtgggttccgcggcggcccggccccagcacttgccggcacctgcagcccgcctagacccggcgctcgggcgtcccgcgctgcacttgctcgccgcgtgactggaggaccgagcccccacattttctttatgtggttgtggtgggggcacagtaatgccctgtgcgccgtagcgttcctgtggggatgtggccggggggcgtcgggaagcgtcactgctgccaggtgcagtggctcacgcctatatttccaggactttgagaggctgaggcgggcggatcacctgagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 107535 - DNA, 2272 bp, Homo sapiens
  Payload ID: 1102
  Gene Symbol: ANKS3
  Gene Name: ankyrin repeat and sterile alpha motif domain containing 3
  ENST ID: ENST00000450067
  CDS Start-End: 225-1874
ctgaccggaaggtccgggtgcgggacgtgtgcattccacggcgcccgggagctgtcccggtgccgacccgcgagcttcccggcgtgctccgcgccctcccgcaactacttccggggcgggtgccgggggcggtgccccggcgagggagcgtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctag

SEQ ID NO: 107536 - DNA, 2265 bp, Homo sapiens
  Payload ID: 1102
  Gene Symbol: ANKS3
  Gene Name: ankyrin repeat and sterile alpha motif domain containing 3
  ENST ID: ENST00000446014
  CDS Start-End: 286-1869
gctagtgcagtggtgtagcaggggcaggaccagcctgtttcatgccctggaacaaccagccaggaaagatctaacccttgggccttcctcctcagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 107537 - DNA, 2302 bp, Homo sapiens
  Payload ID: 1102
  Gene Symbol: ANKS3
  Gene Name: ankyrin repeat and sterile alpha motif domain containing 3
  ENST ID: ENST00000592077
  CDS Start-End: 135-320
agctgtttggggggggttggcgacggcagcccgagggcggcgcaaggcctgaggcccagcacaggccaggtgcagtggctcacgcctatatttccaggactttgagaggctgaggcgggcggatcacctgagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 107538 - DNA, 1946 bp, Homo sapiens
  Payload ID: 1102
  Gene Symbol: ANKS3
  Gene Name: ankyrin repeat and sterile alpha motif domain containing 3
  Uniprot ID: Q6ZW76
  ENST ID: ENST00000585773
  CDS Start-End: 144-1895
gcggtgccccggcgagggagcgtggcggcgagctgtttggggggggttggcgacggcagcccgagggcggcgcaaggcctgaggcccagcacaggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtg

SEQ ID NO: 107539 - DNA, 916 bp, Homo sapiens
  Payload ID: 1102
  Gene Symbol: ANKS3
  Gene Name: ankyrin repeat and sterile alpha motif domain containing 3
  ENST ID: ENST00000592068
  CDS Start-End: 40-684
agcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcct

SEQ ID NO: 107540 - DNA, 566 bp, Homo sapiens
  Payload ID: 1102
  Gene Symbol: ANKS3
  Gene Name: ankyrin repeat and sterile alpha motif domain containing 3
  ENST ID: ENST00000587005
  CDS Start-End: 40-420
agcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagct

SEQ ID NO: 107541 - DNA, 672 bp, Homo sapiens
  Payload ID: 1102
  Gene Symbol: ANKS3
  Gene Name: ankyrin repeat and sterile alpha motif domain containing 3
  ENST ID: ENST00000586166
  CDS Start-End: 155-672
gggcgggtgccgggggcggtgccccggcgagggagcgtggcggcgagctgtttggggggggttggcgacggcagcccgagggcggcgcaaggcctgaggcccagcacagggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctg

SEQ ID NO: 107542 - DNA, 868 bp, Homo sapiens
  Payload ID: 1102
  Gene Symbol: ANKS3
  Gene Name: ankyrin repeat and sterile alpha motif domain containing 3
  ENST ID: ENST00000586159
  CDS Start-End: 226-411
gctgaccggaaggtccgggtgcgggacgtgtgcattccacggcgcccgggagctgtcccggtgccgacccgcgagcttcccggcgtgctccgcgccctcccgcaactacttccggggcgggtgccgggggcggtgccccggcgagggagcgtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctggg

SEQ ID NO: 107543 - DNA, 566 bp, Homo sapiens
  Payload ID: 1102
  Gene Symbol: ANKS3
  Gene Name: ankyrin repeat and sterile alpha motif domain containing 3
  ENST ID: ENST00000592190
  CDS Start-End: 76-566
gtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgag

SEQ ID NO: 107544 - DNA, 2198 bp, Homo sapiens
  Payload ID: 1102
  Gene Symbol: ANKS3
  Gene Name: ankyrin repeat and sterile alpha motif domain containing 3
  ENST ID: ENST00000590730
  CDS Start-End: 102-344
cgggggcggtgccccggcgagggagcgtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggtaagaccgcttgtgaaactggaggttacactcagagacggcactttttgtgacttaggaggcatgtgttgtgtatatgacgtgccaggcgctgctaggagaacagaatggcggtggcatccccatggcctgttaggctccacaggctcacagccggctccatggctggcagccccgctgcagcgcttctactctgttcctctccacggaaaggacctgtctccctgctttccatactggagttggcctccctgagcctggggagaagaaaagcacacttgacctcagagctgcctgcaggagtctgacaagatgtggttgaagcagagacaggaactacacacagtgtgtgcttggtgatggttacagctgccaccatcctcctcctttctgtggtccctctgaccacacattaccttagggatcagaggtgtgactcacagctcagctgtctcacctgtgtctgctgagttctcctaccctgtgtgggcagaagaggcacggagaggagaggcagagggaagctctggttggttatttggtttgtttgttcgagacggagtctcgcactgtcatctgggctggagtgcagtggcgcgatctcggctcactgcaacctcctcctcctgggttcaagcgattctcctgcctcagcctcccaagtagctgggattacaggcacccgccaccatgcccatctaattttttgtatttttagtagagacgggatttcactatgttggccaggctggtctcaaattcctgacatcgtgatccgcccgcctcgacctcccaaagtgctgggattacaggcgtgagccaccacacctggcctggtgccatgcccggcctggctggttatttgttaaagcactggctttgctgttcagtagagccttggatttgccggcttctccctgcagcccctggctcagtgagcaggcacacgtctcggtcccttcaacatacgttgagtggagtctggtcagggtagtgtcctaagtatgtttctttcagaaaatagcttgaagaaaatgtcagagtaacatttgtttgtccattaaaagcaataaactctcaaaagtaggatttctggagttgaaaagtaaatgaaatgaaaatatcactagacgagctcacagcagaattgagcaggcagaagagtcagacaacttgtgaacacaggtcacctgagatcatctcgcttgaggaacag

SEQ ID NO: 107545 - DNA, 1146 bp, Homo sapiens
  Payload ID: 1102
  Gene Symbol: ANKS3
  Gene Name: ankyrin repeat and sterile alpha motif domain containing 3
  ENST ID: ENST00000592421
  CDS Start-End: 193-1146
attccacggcgcccgggagctgtcccggtgccgacccgcgagcttcccggcgtgctccgcgccctcccgcaactacttccggggcgggtgccgggggcggtgccccggcgagggagcgtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactca

SEQ ID NO: 107546 - DNA, 561 bp, Homo sapiens
  Payload ID: 1102
  Gene Symbol: ANKS3
  Gene Name: ankyrin repeat and sterile alpha motif domain containing 3
  ENST ID: ENST00000589065
  CDS Start-End: 163-561
ggtgccccggcgagggagcgtggcggcgagctgtttggggggggttggcgacggcagcccgagggcggcgcaaggcctgaggcccagcacaggccaggtgcagtggctcacgcctatatttccaggactttgagaggctgaggcgggcggatcacctgagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaa

SEQ ID NO: 107547 - DNA, 867 bp, Homo sapiens
  Payload ID: 1102
  Gene Symbol: ANKS3
  Gene Name: ankyrin repeat and sterile alpha motif domain containing 3
  ENST ID: ENST00000588513
  CDS Start-End: 1-867
tctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcggggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctgga

SEQ ID NO: 107548 - DNA, 540 bp, Homo sapiens
  Payload ID: 1102
  Gene Symbol: ANKS3
  Gene Name: ankyrin repeat and sterile alpha motif domain containing 3
  ENST ID: ENST00000591281
  CDS Start-End: 52-237
gttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacatggagtcgccctctgtcgcccaggctggagtgcagcagcttactgcaatctctgcctcccgtgttgaagcgattctcctgcctcagcctcccgagtagctgggattacaggtgt

SEQ ID NO: 107549 - DNA, 2291 bp, Homo sapiens
  Payload ID: 1102
  Gene Symbol: ANKS3
  Gene Name: ankyrin repeat and sterile alpha motif domain containing 3
  ENST ID: ENST00000590193
  CDS Start-End: 47-469
cgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 107550 - DNA, 1128 bp, Homo sapiens
  Payload ID: 1102
  Gene Symbol: ANKS3
  Gene Name: ankyrin repeat and sterile alpha motif domain containing 3
  ENST ID: ENST00000592698
  CDS Start-End: 803-1128
ggcgggtgccgggggcggtgccccggcgagggagcgtggcggcgagctgtttggggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcatggccgcctggagggcgcccgccccacgcagaggagatgaggccgtaacgcacgttctgtgttctcttgaagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctg

SEQ ID NO: 107551 - DNA, 968 bp, Homo sapiens
  Payload ID: 1102
  Gene Symbol: ANKS3
  Gene Name: ankyrin repeat and sterile alpha motif domain containing 3
  ENST ID: ENST00000586605
  CDS Start-End: 204-968
ggagctgtcccggtgccgacccgcgagcttcccggcgtgctccgcgccctcccgcaactacttccggggcgggtgccgggggcggtgccccggcgagggagcgtggcggcgagctgtttggggggggttggcgacggcagcccgagggcggcgcaaggcctgaggcccagcacagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccag

SEQ ID NO: 107552 - DNA, 723 bp, Homo sapiens
  Payload ID: 1102
  Gene Symbol: ANKS3
  Gene Name: ankyrin repeat and sterile alpha motif domain containing 3
  ENST ID: ENST00000590147
  CDS Start-End: 226-723
cacaggtgggttccgcggcggcccggccccagcacttgccggcacctgcagcccgcctagacccggcgctcgggcgtcccgcgctgcacttgctcgccgcgtgactggaggaccgagcccccacattttctttatgtggttgtggtgggggcacagtaatgccctgtgcgccgtagcgttcctgtggggatgtggccggggggcgtcgggaagcgtcactgcttgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccg

SEQ ID NO: 107553 - DNA, 580 bp, Homo sapiens
  Payload ID: 1102
  Gene Symbol: ANKS3
  Gene Name: ankyrin repeat and sterile alpha motif domain containing 3
  ENST ID: ENST00000592711
  CDS Start-End: 193-537
acttgccggcacctgcagcccgcctagacccggcgctcgggcgtcccgcgctgcacttgctcgccgcgtgactggaggaccgagcccccacattttctttatgtggttgtggtgggggcacagtaatgccctgtgcgccgtagcgttcctgtggggatgtggccggggggcgtcgggaagcgtcactgcttgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcgggagccgatatgtggatttactcccttgatggaagcagctgctgctggccatgagataatcgtgcagtattttctgaatcactcgccctctgtcgcccaggctggagtgcagcagcttactgcaatctctgcctcccgtgttgaagcgattctcctgcctcagcctcccgagtagctgggattacagggagtcaaggtggacgcgagagaccacagtg

SEQ ID NO: 107554 - DNA, 2387 bp, Homo sapiens
  Payload ID: 1102
  Gene Symbol: ANKS3
  Gene Name: ankyrin repeat and sterile alpha motif domain containing 3
  Uniprot ID: Q6ZW76
  ENST ID: ENST00000614075
  CDS Start-End: 19-1989
gggccttcctcctcagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcgggaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctgcgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctag

SEQ ID NO: 107555 - DNA, 4352 bp, Homo sapiens
  Payload ID: 1103
  Gene Symbol: ANKS4B
  Gene Name: ankyrin repeat and sterile alpha motif domain containing 4B
  Uniprot ID: Q8N8V4
  ENST ID: ENST00000311620
  CDS Start-End: 74-1327
ataggaaggttgctccgccaacaccttgctctgcctggagagacatctggccaagttctggtgagcaggaaaaatgtctactcgttaccaccaagctgctagtgatagttacctggaacttctaaaagaggctaccaagcgagatctaaatctttcggatgaagacggcatgactcctactctcttggcagcctaccatgggaacttggaagccctagagataatctgcagtagaggaggggaccctgataggtgtgacatctggggaaacactcctctacattttgcagcctccaatggccatgcccactgcgtctcattcctggtcaactttggtgccaacatctttgccctggataatgacttacagactccactggatgctgctgccagcagggagcagaatgaatgtgttgctctcctggacaaggctgccactgcacagaacatcatgaaccccaagaaggtcaccaggctgaaggagcaggctcagaagaatgccaggaggcagatcaaagagtgtgagaggctccaggagaagcaccaaaataagatggcccacacctacagcaaggaggaatccgggactctctcttcttccaagggtaccttctccagatcatccccttcaaatgcttctgctcctggcacattcgggtcactatctaagggcattaaagacactttcaagatcaagttcaagaagaacaaagatacagcagaacaggtggggaaggaaggcagaagtgggcagaggaacgtgatggaagtgttcagagaggaagaggaagactcgttctcaggggacttcaaagagaagctccagttgtcagcagaggaggacggcagtgtgcaccatgaatccattctcaatcgtccaggtctaggaagtattgtttttagaaggaacaggatatcgagtcctgaagacatctcagatagcaagagagagtttggttttaaactgcccagtgaattgcttcaaagacaaggagcatcagaggctgatgagggtgcagctgatgaagagggagaggaaaacggcctcaaagatgatctgccgtgggatgacgatgaagtggagtgggaggaagatgtggtcgatgccacgcccctggaagtgttcttgctgtctcagcacctggaagaattcctgcctatcttcaagagagagcagattgatctagaagctctgctgctctgctctgatgaggaccttcagagcatacaaatgcagctgggtcccaggaagaaagttctgaatgctatcaacaggaggaagcaggtgcttcaacagcctgggcagctggtcgacaccagcctgtgatggagagttttggcctggagcattggggtgatgctgtggcccgctggcagcactccaggcggcaccccctctttacccaatgccagaccactgggaatggattctagggcatcggaaatgcctacctgagagagagacccaaactttactctgggaggtaggctatgcccatccaaataaatctccatgagaaacttgaggagacttcataacaagaatctggcatttctcttcagttatcttatatgtacatataattgtttttgtggttgttttgttttgttttgttttgttttttggagatgaaggtctcagtctcttacccaggctagggtgcagtggtatgatcatagttcactgtattctcaacctcctgggctcaaatgatctcctcccacctcagcctcccaagtagctgagactacaggttcacaccccccacacctggcttattttgtatgttttagtagaggtggggtcttgccacattgcccaggctggtctcaaactcctggcctcaagcaatcctcccacctcagcctcctaaagcactgggattacaggtgtgaaccaccgtacccagcctatctttttgatacttttgaataaagaaagggtcatatgcatgacaggaaaatgaaagaaacttcctttacttttctatctctggatttaaaattataatctcatcacattatcctgctgcttgctttccgatctgtgtaacctgggaattccaattctttttctctcctgagatctatgactttgcctagtggtagagactagagttctttcctggcctgcggcttgatgcccaacttaaatgcatctaaccctttaacaaatgtgtacatgtttacaagtaatggaaatgcgtctataatactcctgcctgagaatagagacagagtggtggtggggagagtgaagaaagagatagaatacaggtggtacctgttgtggactgaattgcgtcaaattcatatgttggagctctaacccctaatgtgactgtaattggaaataagacctttaaagaagtgattaaggttaaatgaagtcataagaatgcaaccctaatcctgtaggactggtgtcctttttttccctttttttttttttttttgagatggagccttgctctgtcactcatgctggagtgcagtggcgtgatctcagctcactgcaacccccgcctcccaggttcgagcacttttcatgcctcagcctcctgagtagctgggattacaggcgtgcaccacaacgcctggctaagtttttgtatttttagtagaggcggggtttcaccatgttggccaggctggtctcaaactcctgacctcaggtgatccacctgcctcggcctcccagagtgctgggattacaggcatgagccactgcacctggcctaggactggtgtcctaagaagaggaagagacacttaggtggaaggcacacagagaggccacgtgaggacacagtgagaaggtggccgtctgcaagccgaggagggggcctcaggagaaaccaaccctgcaatcaccttgatcttgggctttcagcccccaaaggtgtgagaaaataaacttcggttgataaactgctgttgttgaagccatccagtctgtggcattttgttatggcagtcctagcagaataatactgtcctaagtaagagggttggggaggagaccaagaaaaatacagaaaaaaagtctgtccaactgcaattgatgagttttgtaagggtaaacacctagtgaaacttaaggggaaaaaaaactaagttctttggagggaagatttgattgtcaaaggaaatttcacattttcatgcttattatgtacacatggtttatttactgttgtctgtcaccattgccgcatatctgaatatgtgtaggttccacgatagaaactgacaacacttggctcatgcctgtaatcccagcactttgggaggcccaggcaggcagatcacctgaggtcaggagttcaagaccagcctggccaacatggcggaaacccgtctctactaaaaatacaaaaattagccaggtgtggtggcgtgtgcctgtaatcccagctacttgggaggctgaggcaagagaattgcttgaacccaaaaggtggaggttgcagtgagttgagattgcaccactgcactctagcccaggcggtaagagagactccatctcaaaaaaaaaaaaaaaaaaaaagaaaaaagaaactgacaacactgctgctgacattttttcaatggcaatcccaaattcaaactgaaaccccactgaagagctaagcttcattagatctctacaggctgacttacatcaagtggaatttactgttgattctgggtataatacagaaacagctgtttatcttcagcttgctttctgatgcacatctgtttgggttacttcaagaggcatcatggaggattcaagtttagggaggatacagatgctcaaatctgatgaacaattggcttattcttcctcaatgaatatattcagaaagcttgttagccattgaataaacacgttgcattaggggatgattgtttacaaataccttatcttgtggaataaactgaagttgtgctttccttcattaacgtgcacagaagcagttggcaaatagaaagtgctcaaaaaagtttgtagtctgtgcctgccactattatatttcatcatcatagatgccagaatcccctcttcacctattgcccggaatctgcctaatgagatatttgctccaccccctgctgtaactacatcatagcaagagagccatcactcaggttggtagaaatgaacttgaacattgactctcatccctttttaggagatatttgccactaggggtctcatcaggtacctctatgctcttcttaggggttcttttcttttatgattgacagaattaataggtgagcgttctccaaagttctcagcatcaaggatatagtctcttcgtcacagagtattgttatataataaaaaaaggtttatacca

SEQ ID NO: 107556 - DNA, 7164 bp, Homo sapiens
  Payload ID: 1104
  Gene Symbol: ANKS6
  Gene Name: ankyrin repeat and sterile alpha motif domain containing 6
  Uniprot ID: Q68DC2
  ENST ID: ENST00000353234
  CDS Start-End: 49-2664
gacgcggccggcggggcggacgggagcgggccgcgcgtggcggcggcgatgggcgagggcgggctgcccccggccttccagctgctgctgcgcgcgtgtgaccagggcgacacggagacggcgcggcggctgctggagccgggggcggcggagccagccgagcgcggcgcggagccggaggcgggcgcggagccggcgggggccgaggtggccgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactacggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgtttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggttttgtgaggagattgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacaga

SEQ ID NO: 107557 - DNA, 2586 bp, Homo sapiens
  Payload ID: 1104
  Gene Symbol: ANKS6
  Gene Name: ankyrin repeat and sterile alpha motif domain containing 6
  ENST ID: ENST00000375019
  CDS Start-End: 324-2078
attctagaagggcaggttcagtgccaggggctgcggtggggtcagcggagcccgctagtaaagtcaaggcccacgcagctgcggactcagacccgggcccagggccctgaccacagcgtgaagaggggatggcgtggccgctcccacctctgccctgacaggaagtttctggagccccgggacagggcggcgagagggcgccgaagaggcaaaagggaacacgcgggtctgcggcgggcgctcctctgagcgtccctggactcccgaatacgggcactggagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgcaggactggcttgcagaa

SEQ ID NO: 107558 - DNA, 2272 bp, Homo sapiens
  Payload ID: 1104
  Gene Symbol: ANKS6
  Gene Name: ankyrin repeat and sterile alpha motif domain containing 6
  ENST ID: ENST00000444472
  CDS Start-End: 1-1024
agacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagcagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacagattttgcaggactggcttgcagaaggaatctccctgggtgaggtgggtcctctggcctcagggggctctgctcctccttaacatgcagcctaagagtggatttagaccctgccttaatttcagccccccagctgagaatccagtcccaaaaataacagttgttgttgccaaagcttgggaatgatagaagggaaatccacacagaatcacgggtagtgagctcgagcacaaagcccagttcattgtcctcggctcccctccccggcactgcgcttccttcctaaggctgagaccacctctccctgcccttgagaactccctttgctccaggacccccgccaacttggggccctgcccagcagagtggagccatctcgcatcagcatagggacctcccaggttcccatttcctgctggagccctctccaaggctgagacacagggcatggccatccttgtgtcggagaccctgtctccacctctaggtttggccttcccctatagggccctcactagggccagtgtattcactgccaagagtctagaatgccattttagtttctgcccaagggagtgtctattttcctcaccatagacactttttattattttattgttatgtttgtgcagggacttaattctttgaaagattattgtttgtcggcctgtgtatattaaatgatgtaaagtt

SEQ ID NO: 107559 - DNA, 2471 bp, Homo sapiens
  Payload ID: 1105
  Gene Symbol: ANKUB1
  Gene Name: ankyrin repeat and ubiquitin domain containing 1
  ENST ID: ENST00000446160
  CDS Start-End: 458-2092
ccctgtgctagtgcatcccaatcaaatatctatttttaagggttcttcaatcagctgtacttatgtaaataagaattcaggagtcagttgatggggaccacatcacaaaagtgtaatttatgagtagcatttttgtatcacatgcttgaagcttgtccatacttgcctcaaccattgtcaagtttgctggtttccgtaatataggaataaggtggctattgactactgccttccgcagataaatatttcctccaaagtagctggtgtctgtgttgcctgatactgtggcactgtgggactaggctcttcacattctacaacttacctttgaggctagacagtgacagctgcctctggctatcatttttgtccttaattgtgaaccggaatttttctagccatccaggagaatctttgaaaaagttggatattttttgtttgaaaaggtaattgtacaatgaggattttcatcgcctttgaaggatcttttgaaccgtttgatgtttcagcagatgaaactgtggaggttgtcaagctgatgataaaggattatttccacattcctctctctgaagacaaacaaggcaggcggtatctggagttaatgtatgctggagctgctctaaaggacagttggagtcttgctgatgttggaatatctttctgttcaactctcaaatgctttgttaaggaagaagacaagcctactctatacgtgttcaatgctgtaactcaagacacaatgccagtaatggagagcatttcccttcttgataaaacagtgtctgatctgagaacactggtaactctgagatgtggcctccccgtgagtgtctactgtctccgaaccccaaggggcctggagatgtatgattgcaacaccctcaaggactaccagactgatattggcacaacacttcgcttggatgtctgggatggatggaaggaatttctgatgggttgtctccttggacaaaaacttaaagtccaacgctacttatcaaaagaaggaccagtactcaagtatcagaaaagggtagccctgtacattgctgctttttgtgggtacattgaactcactgaatgggccctgaagcagggtgcgcggccccacgaggcagtcggtgttcacccctatcgagcatggtgccatgaagcccttcatgcagatgtctctaaatgccccattcatgcagccgcagaagcaggccaactgttgattctgaaggcctttgtcaactacagtgtgctgtgcctggaatgcaaaaatgcagcaggacaaactcccctgaccattgtgttcaaacacaagcataaagactgtgtattatatttgctcagtaaaatgtggtccacagtttcttttccaaaaatttcagtcccaatgaggatttatattaaaataaaacaatggatcctcagagctcagagtcacagtcttcataaaagccagttttgtggagcaagggtctttggggcaaaagttggagacactgtgatggtggatggtttcaccaaaccaaaaatgacctccaagagctggcataaggctgggaacagcgactcacaaagcatcgtgctcaagctaccatctctcagcaaacaaactgcaagcagcaaacctgtcaatcctttggcaatttcacagccggacacaagaaaacaagccctcaaatttcatccactggtgaatgcaagttcattctctgaattacaaaaacatcaacaacaaaatcagaaaaaaattactgccacagctaggaaaaaagaaaagctcataaaaaacacatatcttccccaagtccccctccctccagtttcaagagtgggatattcacatccatcgtttttctatgcaacacccagtgctgactttttactgaagtcctccttctcatctttcttagagcacagtgggaagactccatgggagaacgcaatctactgcttagctgtggcaagtgcctttaaagagaaacgatggcttcagcagttagaaatagcaagagtcctggccaaaaagagcatttctaacttgactacccgaggaggtctgacagcgtgtgaaaactctctagaaactgtgctttgaaaagtcatgacaacttcagtttggacaaagacctgatcaaacagaatgtccagttctaatgttaacatttctaataacagttctaatgttatcatctctagtaacagttataatgccacataacttttaataggatatttaacaccatgttttctcagacttcatcacactaagtgaaactttagtgctatttttgcataaagaatatgaggaagaattcagaagaaacttagaatagtagttgtccacagggtaggggagctgagacaatggaaaacaaggaagtgggaatttttacagttcctttgtttgtttttctttttttttcctaaaaaaatgtgttttggttttttaagccatatgaatgtagaacatattt

SEQ ID NO: 107560 - DNA, 2434 bp, Homo sapiens
  Payload ID: 1105
  Gene Symbol: ANKUB1
  Gene Name: ankyrin repeat and ubiquitin domain containing 1
  Uniprot ID: A6NFN9
  ENST ID: ENST00000462519
  CDS Start-End: 401-1909
tacttatgtaaataagaattcaggagtcagttgatggggaccacatcacaaaagtgtaatttatgagtagcatttttgtatcacatgcttgaagcttgtccatacttgcctcaaccattgtcaagtttgctggtttccgtaatataggaataaggtggctattgactactgccttccgcagataaatatttcctccaaagtagctggtgtctgtgttgcctgatactgtggcactgtgggactaggctcttcacattctacaacttacctttgaggctagacagtgacagctgcctctggctatcatttttgtccttaattgtgaaccggaatttttctagccatccaggagaatctttgaaaaagttggatattttttgtttgaaaaggtaattgtacaatgaggattttcatcgcctttgaaggatcttttgaaccgtttgatgtttcagcagatgaaactgtggaggttgtcaagctgatgataaaggattatttccacattcctctctctgaagacaaacaaggcaggcggtatctggagttaatgtatgctggagctgctctaaaggacagttggagtcttgctgatgttggaatatctttctgttcaactctcaaatgctttgttaaggaagaagacaagcctactctatacgtgttcaatgctgtaactcaagacacaatgccagtaatggagagcatttcccttcttgataaaacagtgtctgatctgagaacactggtaactctgagatgtggcctccccgtgagtgtctactgtctccgaaccccaaggggcctggagatgtatgattgcaacaccctcaaggactaccagactgatattggcacaacacttcgcttggatgtctgggatggatggaaggaatttctgatgggttgtctccttggacaaaaacttaaagtccaacgctacttatcaaaagaaggaccagtactcaagtatcagaaaagggtagccctgtacattgctgctttttgtgggtacattgaactcactgaatgggccctgaagcagggtgcgcggccccacgaggcagtcggtgttcacccctatcgagcatggtgccatgaagcccttcatgcagatgtctctaaatgccccattcatgcagccgcagaagcaggccaactgttgattctgaaggcctttgtcaactacagtgtgctgtgcctggaatgcaaaaatgcagcaggacaaactcccctgaccattgtgttcaaacacaagcataaagactgtgtattatatttgctcagtaaaatgtggtccacagtttcttttccaaaaatttcagtcccaatgaggatttatattaaaataaaacaatggatcctcagagctcagagtcacagtcttcataaaagccagttttgtggagcaagggtctttggggcaaaagttggagacactgtgatggtggatggtttcaccaaaccaaaaatgacctccaagagctggcataaggctgggaacagcgactcacaaagcatcgtgctcaagctaccatctctcagcaaacaaactgcaagcagcaaacctgtcaatcctttggcaatttcacagccggacacaagaaaacaagccctcaaatttcatccactggtgaatgcaagttcattctctgaattacaaaaacatcaacaacaaaatcagaaaaaaattactgccacagctaggaaaaaagaaaagctcataaaaaacacatatcttccccaagtccccctccctccagtttcaagagtgggatattcacatccatcgtttttctatgcaacacccagtgctgactttttactgaagtcctccttctcatctttcttagagcacagtgggaagactccatgggagaacgcaatctactgcttagctgtggcaaggtaatgttctccccttaaacatacaaacagcaaagcttttataaggcaggtccaggataaggaatggtccataatgccctactatgccactgaaagtaatacaagttgttccagtgcatcaatacccagcttcaaggacctcatcttagcctcatcactaggacaaaatgaattaatattattggccaatccaatctgtgcagtactttactcctcaaactttcaggagggaaagaaacacagtagaaagaattgtatcaattctcaaggtcccttgctgctgctgctgctgctgctgctgctgctgctgctgctgctgctgctgctgctgctgctgcttttcttttttctttttgtttgagacagggtctcgttctgttgctcaggctggagtgcagtggtgctatcacagctcattgcattcttgaattcctaggctcaagcaattctcccatctcagccttccaagtagctgggactacaggcacatgccactatatctgattgattttttttttctgtagagatg

SEQ ID NO: 107561 - DNA, 2027 bp, Homo sapiens
  Payload ID: 1105
  Gene Symbol: ANKUB1
  Gene Name: ankyrin repeat and ubiquitin domain containing 1
  ENST ID: ENST00000484019
  CDS Start-End: 458-577
ccctgtgctagtgcatcccaatcaaatatctatttttaagggttcttcaatcagctgtacttatgtaaataagaattcaggagtcagttgatggggaccacatcacaaaagtgtaatttatgagtagcatttttgtatcacatgcttgaagcttgtccatacttgcctcaaccattgtcaagtttgctggtttccgtaatataggaataaggtggctattgactactgccttccgcagataaatatttcctccaaagtagctggtgtctgtgttgcctgatactgtggcactgtgggactaggctcttcacattctacaacttacctttgaggctagacagtgacagctgcctctggctatcatttttgtccttaattgtgaaccggaatttttctagccatccaggagaatctttgaaaaagttggatattttttgtttgaaaaggtaattgtacaatgaggattttcatcgcctttgaaggatcttttgaaccgtttgatgtttcagcagatgaaactgtggaggttgtcaagctgatgataaagacaaacaaggcaggcggtatctggagttaatgtatgctggagctgctctaaaggacagttggagtcttgctgatgttggaatatctttctgttcaactctcaaatgctttgttaaggaagaagacaagcctactctatacgtgttcaatgctgtaactcaagacacaatgccagtaatggagagcatttcccttcttgataaaacagtgtctgatctgagaacactggtaactctgagatgtggcctccccgcacaacacttcgcttggatgtctgggatggatggaaggaatttctgatgggttgtctccttggacaaaaacttaaagtccaacgctacttatcaaaagaaggaccagtactcaagtatcagaaaagggtagccctgtacattgctgctttttgtgggtacattgaactcactgaatgggccctgaagcagggtgcgcggccccacgaggcagtcggtgttcacccctatcgagcatggtgccatgaagcccttcatgcagatgtctctaaatgccccattcatgcagccgcagaagcaggccaactgttgattctgaaggcctttgtcaactacagtgtgctgtgcctggaatgcaaaaatgcagcaggacaaactcccctgaccattgtgttcaaacacaagcataaagactgtgtattatatttgctcagtaaaatgtggtccacagtttcttttccaaaaatttcagtcccaatgaggatttatattaaaataaaacaatggatcctcagagctcagagtcacagtcttcataaaagccagttttgtggagcaagggtctttggggcaaaagttggagacactgtgatggtggatggtttcaccaaaccaaaaatgacctccaagagctggcataaggctgggaacagcgactcacaaagcatcgtgctcaagctaccatctctcagcaaacaaactgcaagcagcaaacctgtcaatcctttggcaatttcacagccggacacaagaaaacaagccctcaaatttcatccactggtgaatgcaagttcattctctgaattacaaaaacatcaacaacaaaatcagaaaaaaattactgccacagctaggaaaaaagaaaagctcataaaaaacacatatcttccccaagtccccctccctccagtttcaagagtgggatattcacatccatcgtttttctatgcaacacccagtgctgactttttactgaagtcctccttctcatctttcttagagcacagtgggaagactccatgggagaacgcaatctactgcttagctgtggcaagtgcctttaaagagaaacgatggcttcagcagttagaaatagcaagagtcctggccaaaaagagcatttctaacttgactacccgaggaggtctgacagcgtgtgaaaactctctagaaactgtgctttgaaaagtcatgacaacttcagtttggacaaagacctgatcaaacaga

SEQ ID NO: 107562 - DNA, 2579 bp, Homo sapiens
  Payload ID: 1106
  Gene Symbol: ANKZF1
  Gene Name: ankyrin repeat and zinc finger domain containing 1
  Uniprot ID: Q9H8Y5
  ENST ID: ENST00000323348
  CDS Start-End: 175-2355
agtgtgctctacgtggggcggggctcaggtgcggacgccgccggttgtcctcttcgctgctccgtagtgacggggattgttgtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaatgtgtacttgtacttaca

SEQ ID NO: 107563 - DNA, 2486 bp, Homo sapiens
  Payload ID: 1106
  Gene Symbol: ANKZF1
  Gene Name: ankyrin repeat and zinc finger domain containing 1
  Uniprot ID: Q9H8Y5
  ENST ID: ENST00000410034
  CDS Start-End: 102-2282
cccgggacgtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaagg

SEQ ID NO: 107564 - DNA, 2155 bp, Homo sapiens
  Payload ID: 1106
  Gene Symbol: ANKZF1
  Gene Name: ankyrin repeat and zinc finger domain containing 1
  ENST ID: ENST00000409849
  CDS Start-End: 381-1931
gcggacgccgccggttgtcctcttcgctgctccgtagtgacggggattgttgtgttgcagaaatccggcaatcgacctgaggacttgcgagccgctcagctcccgggacgtttggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacctgcaaagtagaggtcccagagactgcgtggtgctcatggctgcagctgggcactttgctggtgctatatttcaaggaagagaagtggtgacacacaaaacttttcaccgctatacggttcgggccaagcggggcacagcccaggggcttcgggatgcccgaggtgggccatcacactctgctggagccaacctgaggcgctacaatgaagccacactatataaggatgttcgtgacctgctggcagggccaagctgggctaaggcgctggaggaggctggtacaatactgttgcgtgctccccgctctggccggtctttgttctttggaggcaagggagcacccctgcaaaggggggatccccgactttgggatatccccctcgccacccgcagacccaccttccaagagctacagcgtgtgctccataagctgaccactttgcatgtctatgaagaagaccctcgggaagcagtcagactgcactcacctcagacacactggaaaacagtaagagaggagagaaagaagcctactgaggaagaaataagaaagatctgcagggatgaaaaggaagcgctggggcagaatgaggaatctcccaaacagggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcaggactctcgggcccggccaccttatactgttgcggctgacaaatcaacacgtaatgagttccgaaggttcatggagaagaatccagatgcctacgattacaacaaggctcaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaagagagctctggctgcagagcgccgactcgctgcccagttgggagcccctacctctccaatccctgactctgcaatcgtcaatactcgacgctgctggagttgtggggcatccctccaaggcctgactccctttcactacctcgacttctctttctgctccacacgttgcctccaggatcatcgccgtcaggcagggaggccctcttcctgatctcttacagctctacctggggccaactcagggacctgagagggcacattcacagcagccctaggttttttcttccccgtgaaaccagagatgatttggaagatgggggtgaaggacactcgggaactagggcaaagacagggctagaggtatgtggagctggtactgtctctggaattttaatcacaataaagtttggcaaggaatgtgtacttgtacttaca

SEQ ID NO: 107565 - DNA, 511 bp, Homo sapiens
  Payload ID: 1106
  Gene Symbol: ANKZF1
  Gene Name: ankyrin repeat and zinc finger domain containing 1
  ENST ID: ENST00000453432
  CDS Start-End: 166-511
aggtgcggacgccgccggttgtcctcttcgctgctccgtagtgacggggattgttgtgttgcagaaatccggcaatcgacctgaggacttgcgagccgctcagctcccgggacgtttggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtg

SEQ ID NO: 107566 - DNA, 571 bp, Homo sapiens
  Payload ID: 1106
  Gene Symbol: ANKZF1
  Gene Name: ankyrin repeat and zinc finger domain containing 1
  ENST ID: ENST00000436226
  CDS Start-End: 300-571
gtaacgaagaaagttcggctaggcaagctcagtgatttttaactctgttggactcgatttgggagccgaatgcctatttcattcttttgtgggctgagactgggggtttgagaaagtggacgggggccaaggtattcatctcacagttggtagcaggatgagagacgagaagtcttgcggtgcaggagaaaccaagtcaggcaggcaggagacgcagcagtaggatctcgtttgcaggagccctgtttcttacacgctttctactccaggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacatta

SEQ ID NO: 107567 - DNA, 537 bp, Homo sapiens
  Payload ID: 1106
  Gene Symbol: ANKZF1
  Gene Name: ankyrin repeat and zinc finger domain containing 1
  ENST ID: ENST00000447157
  CDS Start-End: 116-537
gtttggtgcgtcttctaagggcgtgggcgagtttacgcgggccagttgttgctggtcgcatgggtaacgaagaaagttcggctaggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggctcaggggagagagaaagcccagaaagaaagctactccagggtcctatggatatttcagagaagttattttgttcaacttgtgaccagaccttccagaaccaccaagaacagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggactt

SEQ ID NO: 107568 - DNA, 576 bp, Homo sapiens
  Payload ID: 1106
  Gene Symbol: ANKZF1
  Gene Name: ankyrin repeat and zinc finger domain containing 1
  ENST ID: ENST00000435521
  CDS Start-End: 94-255
gtgttgcagaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcagagggaacattataagcttgactggcatcggtttaacctaaagcaacgtctcaaggacaagcctctcctgtctgccctggactttgaaaagcagagctccacaggagatctttccagcatctcgggatcagaagactcagactcagccagtgaggaggacttgcagacactggatcgggagagggctacatttgagaagttgagccgacccccaggcttttaccctcatcgagttcttttccagaatgcccagggccagtttctttatgcctaccgctgtgtcctaggccctcatcaggatcccccagaagaggcagaactgctgctacagaacct

SEQ ID NO: 107569 - DNA, 552 bp, Homo sapiens
  Payload ID: 1106
  Gene Symbol: ANKZF1
  Gene Name: ankyrin repeat and zinc finger domain containing 1
  ENST ID: ENST00000416565
  CDS Start-End: 374-552
gctcccgggacgtttggtgcgtcttctaagggcgtgggcgagtttacgcgggccagttgttgctggtcgcatgggtaacgaagaaagttcggctaggcaagctcagtgatttttaactctgttggactcgatttgggagccgaatgcctatttcattcttttgtgggctgagactgggggtttgagaaagtggacgggggccaaggtattcatctcacagttggtagcaggatgagagacgagaagtcttgcggtgcaggagaaaccaagtcaggcaggcaggagacgcagcagtaggatctcgtttgcaggagccctgtttcttacacgctttctactccaggagctgctgctaaataatttctgctcagccatgtcgccggctccagatgcagccccggctcctgcgtcgatctccctgtttgacctcagcgcggatgctccggtctttcagggcctgagcctggctcaggggagagagaaagcccagaaagaaagctactccagggtcctatggatatttcagagaagttattttgttcaacttgtgac

SEQ ID NO: 107570 - DNA, 1979 bp, Homo sapiens
  Payload ID: 1107
  Gene Symbol: ANKRD1
  Gene Name: ankyrin repeat domain 1 (cardiac muscle)
  Uniprot ID: Q15327
  ENST ID: ENST00000371697
  CDS Start-End: 250-1209
acatattcagcagggttagcttgtcctcccctccctcttcagcttcccagacactgagtctggaatgaaaattcacctgcctctgagttggctcctaatgggggtgggagtgttacttcggttcccaggttggaagattatctcacccggccccagctatataagctgaccggtgtggaggggcccagcagggccaactccagggattccttccacgacagaaaaacatacaagactccttcagccaacatgatggtactgaaagtagaggaactggtcactggaaagaagaatggcaatggggaggcaggggaattccttcctgaggatttcagagatggagagtatgaagctgctgttactttagagaagcaggaggatctgaagacacttctagcccaccctgtgaccctgggggagcaacagtggaaaagcgagaaacaacgagaggcagagctcaaaaagaaaaaactagaacaaagatcaaagcttgaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccatccactgggcaagccgtggaggaaacctggatgttttaaaattgttgctgaataaaggagcaaaaattagcgcccgagataagttgctcagcacagcgctgcatgtggcggtgaggactggccactatgagtgcgcggagcatcttatcgcctgtgaggcagacctcaacgccaaagacagagaaggagataccccgttgcatgatgcggtgagactgaaccgctataagatgatccgactcctgattatgtatggcgcggatctcaacatcaagaactgtgctgggaagacgccgatggatctggtgctacactggcagaatggaaccaaagcaatattcgacagcctcagagagaactcctacaagacctctcgcatagctacattctgaggcaaacgacagactcttaatcagtaaatgttcactggcattttgaaggcatggcccaagagaagagacactagccataaaatctagtttctatttatcaacgtgttgtgaagatgtacctaatgaagttttgagaaagcacagggttataggtgtttaaatttcctttagtgaaactcttatttatttttatgtattcctgtttatttatttactgccacgctactgatattcagaccttcatgatcatccatctggtgagcagagcttcatttgtatataacactttcagagccttcccacccataggtagttcttaaaccaggtgaaagagcaaagttcaagtgcctacttatgtgtcattcgctcatgtaagagtttttaagagagggctgattatcacagccctcttttctcctgaatttttaatgcagaagtttgaatgaagcaagggaaggcatgtagggacaggaaaggaaacaatggaaggaaagtgattctgtgaaaaggacagtgaagccagctattttacccccaggctggattttttttttttttttttttttttttttttaccgagtacacagagtacccaagtgaagagaacgtcatgagtgtaagtgcaaatcagtggaaggagcggcaaactgggacatgcagaattgaatttgctcaaaaaagatgaaaggaaatgcaaactgtaaatgtataaatgtatattgtattgtatgtacattttatattcataataaaggcaatcaaactctaaa

SEQ ID NO: 107571 - DNA, 2495 bp, Homo sapiens
  Payload ID: 1108
  Gene Symbol: ANKRD10
  Gene Name: ankyrin repeat domain 10
  Uniprot ID: Q9NXR5
  ENST ID: ENST00000267339
  CDS Start-End: 136-1398
gcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgacctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacagatatgaaaaacagtagctccgtatcgaatacattgacaaatggatgtgtcatcaatggacatttggacttcccctccacgaccccgctcagtgggatggaaagcaggaatggccagtgcttgacaggaactaacggaattagcagtggattagccccaggacagccgtttccgagtagccagggttctctctgcattagtgggactgaggagccagagaagaccctgagagctaaccctgagttgtgcggttctctgcacctgaacgggagtccaagtagctgcatagccagtaggccttcctgggtggaagacattggggataacctgtactatggacactaccacgggtttggggacactgctgaaagcatcccagaactgaacagtgtggtcgagcattccaagtccgtgaaggtgcaggagcggtacgacagtgccgtgctgggcaccatgcacctgcaccacggctcctagagacgctgacctggctctcggaaacgcaggagtccttcctggtagccagctcagaatacccatgtagcagcaacttgaacgaatgtcacaacttgtacgttttttatatacttcaactttctgaaaaagtaaacttcgacaagttcccagcaactgcttgtttgtgcatgagtagggcttactaagtgcatagatgtttctacagtgaggtgtcctttttataaggtgcacttttggagtttttctgatgccaatctcaacattgtctttttaatactgtcaccagatattgccatttttctttttgttaaaagattatatgatcaagataaattggggtggtaaatcaggtgcctggtaatttatctctttgcacatgggcatcattttaaaaagcttgcttccactcttttctgtagaatttgacggaacacagctatttccctatgcaaggtacagccttacaaagatttctgcagtgatttgtgtgaagaagagaacgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtggaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactctgcaaatattgtaatgaatttttacttttttgatttttgtaataaaaattggtgcagataaaatgtcaaatgaacaaaccagtgttctaagagtgttactaacattttgttctaaaactgtccttcacaaattgaataaaaaactctcacactca

SEQ ID NO: 107572 - DNA, 1193 bp, Homo sapiens
  Payload ID: 1108
  Gene Symbol: ANKRD10
  Gene Name: ankyrin repeat domain 10
  Uniprot ID: Q9NXR5
  ENST ID: ENST00000310847
  CDS Start-End: 73-735
ggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgagtttatttcacagagcagtgtacattcttgtcttccaggggaacttcaacatggagttacttttgatccctcagttttaattcagtgtctaaagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggctgagcgcaccttcgagatgagaccttcacttcaggtggtaatgcgcctggtggattgtgcggtgacggtggagatttctcctgtactgccactgcgaagatgggacttaacaaaagggaatgtgagggaaatactgatggcccaagtgtaaatgtctatgtggaactttttgagcacccatgtttacctgccatgaattagattttttaatttgttgtatctgtttgaaatatatctattaaagaaaatctgccactgtgcctgaa

SEQ ID NO: 107573 - DNA, 997 bp, Homo sapiens
  Payload ID: 1108
  Gene Symbol: ANKRD10
  Gene Name: ankyrin repeat domain 10
  ENST ID: ENST00000465753
  CDS Start-End: 104-589
ccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcgctgctgcagcagacaccccacgcccacctggcctctgaggactccttctatggctggacgcccgtgcactgggccgcgcatttcggcaagttggagtgcttagtgcagttggtgagagcgggagccacactcaacgtctccaccacacggtacgcgcagacgccagcccacattgcagcctttgggggacatcctcagtgcctggtctggctgattcaagcaggagccaacattaacaaaccggattgtgagggtgaaactcccattcacaaggcagctcgctctgggagcctagaatgcatcagtgcccttgtggcgaatggggctcacgtcgataatcctagaaagggggagcattccatatagaaactgctgaaactgccacaggtgcttctccgaaaaccttacagttgtggcattgaatgttcagtatcgcttcctttctgcacacgaggcatactgttgagcctgagaaatgccagtggcctgacagcagcagacattgcacaaacccagggtttccaagagtgtgcccagtttctcttgaacctccagaattgtcatctgaaccatttctataacaatggcatcttaaatgggggtcatcagaatgtatttcctaatcatattagtgtgggaacaaatcgaaagagatgcttggaagactcagaagactttggagtaaagaaagctagaactgaaggtgagaccgctttgcgggtgggaagagcacacttatttttcctttctgtaatatgttttctttttatggct

SEQ ID NO: 107574 - DNA, 704 bp, Homo sapiens
  Payload ID: 1108
  Gene Symbol: ANKRD10
  Gene Name: ankyrin repeat domain 10
  ENST ID: ENST00000603993
  CDS Start-End: 1-365
ggggtcatcagaatgtatttcctaatcatattagtgtgggaacaaatcgaaagagatgcttggaagactcagaagactttggagtaaagaaagctagaactgaagctcaaagcttggattctgccgtgccactcacgaatggcgacacagaagacgatgctgacaaaatgcacgttgatagggagtttgctgttgtaacaggtgggagtggacagtttcctgttagctgcaacaacaatccaatggttgaagacaccaaacagcaggagagtggttctgttggaccaaaagaaatagaaatatatactgtgtcagcaatgcagaccccctgtcgttgcaggaatcagtatgcatattatttctaacataagtttttctcagatgttttgcactttgttgtccagtgtctttttaaaaatgttatactataatttgcatatcttgggcaagtttgtagatacaagaagtgttttgggtatattctgtggacatgaaaaatgtaagtgcaatctttattctgatttgaagctattgcttaatgtgccttgcttatttttaatgaggtttgcatttttaattttctgacatatggcctttgggtgaatataccgaacatgctacagttaatattttcaaaccaatataccacaaagaggacgactagcagtaaacactgagaaactagtaaatgtggttctgactca

SEQ ID NO: 107575 - DNA, 9301 bp, Homo sapiens
  Payload ID: 1109
  Gene Symbol: ANKRD11
  Gene Name: ankyrin repeat domain 11
  Uniprot ID: Q6UB99
  ENST ID: ENST00000301030
  CDS Start-End: 462-8453
agaggccgccctgagacggtgcgcgatggaccgagggccccagccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccaggggcccccggggtcataaacggtggggatgtttccaccgtagtggctgaggagccgccggcactgcctcctgaccaggcctccacccggctccctgcagagctcgagcctgagccctcaggggagccaaagctggacgtggctctagaagctgcggtggaggcggagacggtgccggaagagagggcccgtggggatccggactccagcgtggagcccgcgcccgttcccccagaacagcgcccactggggagcggagaccagggggctgaggctgaaggcccccccgccgcgtccctctgtgcccctgacggccccgccccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaa

SEQ ID NO: 107576 - DNA, 8342 bp, Homo sapiens
  Payload ID: 1109
  Gene Symbol: ANKRD11
  Gene Name: ankyrin repeat domain 11
  ENST ID: ENST00000330736
  CDS Start-End: 124-417
gtgagagtggatgagttttgagctgcctctgaattcagtgaattgtgtgtcttctcttttgaagcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccaggggcccccggggtcataaacggtggggatgtttccaccgtagtggctgaggagccgccggcactgcctcctgaccaggcctccacccggctccctgcagagctcgagcctgagccctcaggggagccaaagctggacgtggctctagaagctgcggtggaggcggagacggtgccggaagagagggcccgtggggatccggactccagcgtggagcccgcgcccgttcccccagaacagcgcccactggggagcggagaccagggggctgaggctgaaggcccccccgccgcgtccctctgtgcccctgacggccccgccccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcactt

SEQ ID NO: 107577 - DNA, 9132 bp, Homo sapiens
  Payload ID: 1109
  Gene Symbol: ANKRD11
  Gene Name: ankyrin repeat domain 11
  Uniprot ID: Q6UB99
  ENST ID: ENST00000378330
  CDS Start-End: 290-8281
ggccgcgggctgcatgggcagcgcccgcgccccgccgctgagccgtcgcggagccgcgcagccctcggagcacgcccgtgcagcctgccaggactcttccagacacgggatttgtcggtgaacaacgcagagctgatgcagacataatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagaccgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccgaggctcggcgatgccaaactgaaggagaaattcaaggacggtgcagagaaagaaaagggcgacccagtgaagatgagcaacgggaatgataaggtagcgccatccaaagacccaggcaagaaagacgccaggcccagggagaagctcctgggggacggcgacctgatgatgaccagcttcgagaggatgctgtcccagaaggacctggagatcgaggagcgccacaagcggcacaaggagaggatgaagcaaatggagaagctgaggcaccggtccggagaccccaagctcaaggagaaggcgaagccggcagacgacgggcggaagaagggtctggacattcctgctaagaaaccgccggggctggaccctccatttaaagacaaaaagctcaaagagtcgactcctattccacctgccgcggaaaataagctacacccagcatcaggtgcagactccaaagactggctggcaggccctcacatgaaagaggtcctgcctgcgtcccccaggcctgaccagagccggcccactggcgtgcccacccctacgtcggtgctatcctgccccagctacgaggaggtgatgcacacgcccaggaccccgtcctgcagcgccgatgactacgcggacctcgtgttcgactgcgccgactcgcagcactccacgcccgtgcccaccgctcccaccagcgcctgctccccctcctttttcgacaggttctccgtggcttcaagtgggctttcggaaaacgccagccaggctcctgccaggcctctctccacaaacctttaccgctcggtctctgtcgacattaggaggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgccccgcggaccccctccactctgccgccccagggcccttcagcgcctcggaggcgccgtaccccgcccctcccgcctctcctgccccgtacgctctgcccgtcgctgagccggggctggaggacgtcaaggacggagtggacgccgtccccgccgccatctccacctcagaggcggctccctacgcccctccctccgggctggagtccttcttcagcaactgcaagtcacttccggaagccccgctggacgtggcccccgagcccgcctgtgtagccgctgtggctcaggtggaggctctggggcccctggaaaatagcttcctggacggcagccgcggcctgtctcacctcggccaggtggagccggtgccctgggcggacgccttcgccggccccgaggacgacctggacctggggcccttctccctgccggagcttcccctgcagactaaagatgccgcagatggtgaagcggaacccgtggaagaaagtcttgctcctccagaagagatgcctccaggggcccccggggtcataaacggtggggatgtttccaccgtagtggctgaggagccgccggcactgcctcctgaccaggcctccacccggctccctgcagagctcgagcctgagccctcaggggagccaaagctggacgtggctctagaagctgcggtggaggcggagacggtgccggaagagagggcccgtggggatccggactccagcgtggagcccgcgcccgttcccccagaacagcgcccactggggagcggagaccagggggctgaggctgaaggcccccccgccgcgtccctctgtgcccctgacggccccgccccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgc

SEQ ID NO: 107578 - DNA, 1982 bp, Homo sapiens
  Payload ID: 1109
  Gene Symbol: ANKRD11
  Gene Name: ankyrin repeat domain 11
  ENST ID: ENST00000378332
  CDS Start-End: 418-525
cggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaagatttttccaaaagaatcgtgatctcagtgacatatacgtggaagatggaaatggagcccacaactctgcagtgcatcctgatgccgcgctgacctgacggcttgtgcgtgtccctttggctgcaccagtgagcacagtggcaggcgtgtcagagaaagggccccttctgcagacggtctctcaccattgccgaccacggaatcccagaaccgctgagctgcctcgggaagaaccagcaggtgtctgcatcgttgagtgtgttctgatccaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcaga

SEQ ID NO: 107579 - DNA, 2762 bp, Homo sapiens
  Payload ID: 1109
  Gene Symbol: ANKRD11
  Gene Name: ankyrin repeat domain 11
  ENST ID: ENST00000562275
  CDS Start-End: 57-350
acggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcatcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcaga

SEQ ID NO: 107580 - DNA, 593 bp, Homo sapiens
  Payload ID: 1109
  Gene Symbol: ANKRD11
  Gene Name: ankyrin repeat domain 11
  ENST ID: ENST00000563291
  CDS Start-End: 101-475
actcactcagcaggggcctccactgatttcgcccgtgctcctggacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggaccgccggggtcctgcttgtcctggggcagccacgagggagccctcgtcaggagcgccatgggccgaagctgcctgccctctgcacgtggatgtttctttggaacaaggggaaaaattatgattttcttattttgctttgacctgtgaatgacaccctggtctctggtgcctggggtgtgctctctgcagtgctgccaggcacatgctggttccttcagcgttaggtgcttggcaccttcagtcttttcctgacgtcatgtttgtt

SEQ ID NO: 107581 - DNA, 618 bp, Homo sapiens
  Payload ID: 1109
  Gene Symbol: ANKRD11
  Gene Name: ankyrin repeat domain 11
  ENST ID: ENST00000562194
  CDS Start-End: 1-616
gtttccaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggccctgaacgccgtgcagaggatggagtggcagctgaaggtgcaggaactggaccccgccgggcacaagtccctgtgcgtgaacgaggtgccctc

SEQ ID NO: 107582 - DNA, 1584 bp, Homo sapiens
  Payload ID: 1109
  Gene Symbol: ANKRD11
  Gene Name: ankyrin repeat domain 11
  ENST ID: ENST00000613312
  CDS Start-End: 219-1319
ggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaa

SEQ ID NO: 107583 - DNA, 11288 bp, Homo sapiens
  Payload ID: 1110
  Gene Symbol: ANKRD12
  Gene Name: ankyrin repeat domain 12
  Uniprot ID: Q6UB98
  ENST ID: ENST00000262126
  CDS Start-End: 241-6429
aatcgcggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaagagtgaaatgtgtgctaactgtttttttacttaattttacttgggcagctagcaaaattgcagaaatatgcatcctgggaaaagaaacagcctttgaagaattagcctttcaagttcaaatctatttaataatgagaagtctcacaagtgaatttttaagtacaggcatacctcagacgtactttaggttccagaccatctcagtaaagcaaataccacaacaaagcgagtcaggaggaattttttggtttcccagtgcatataaaagttttgtttatactatattaagtgtgcaatagcattatgtctaaaaatatgtacataagtttaaaaatattttattgctaaaaatggtaacaaagtgagcacatgctgttggaaaaagagcaccaatagacttgcttgaagcagggttgccacaaaccttcaatttgtaaaaaacgccaatatgtacaaagcacaataaagcaaagcacaatagaacaggattgcctgtattagacatgctacaaacttcataactggaaacatctcaaagaccccatgaagctcatttgaatgggacttaacaattagacagttattttagaaattgagtgcagacctaaatacatagttttccaaaaagaaaattattgtctctgatatcttaaaacataaaaacccaaaattttatatagaagaaattgactctgtaaaacgcaatgaaatagtcctctttttaaacagtttaaaggaagcattttcaccgtttgtaaaaattatttttaaatatttagggcaaaatttttgttagataataatggaaaagcttgtgtgagtttagtggttaaaatatcttgtaattcatcattatttaagtgacttcttgggagccgtctttgtacctaaaatggagtttttttttaagcctccacagagatagtcacccaaagtatttccagtcagtaaaagtagaattcatagaaaaaactgaggcaaattaaaacaattccattaatcaaaatggctttaaacaaattaagtattagcataaaaatagcaaaaagtacaactaaaaaaatggttgggttttcccagtggttaaatgctatataataactgcaaataaaagtttttttgtacatggacagcgtcctcataaaagaaaataggccaggccaggcgcagtggctcgcgcctgtaatcccagcactttgggaggccaaggcgggcggatcacgaggtcaggagatcgagaccatcctggctaacacggtgaaaccccgtctctactaaacaaaatgcaaaaaatcagccgggtgtggccgcgggcgcctgtagttccagctactcgggaggctgaggcaggagaatggcgtgagcctgggaggcggagcttgcagtgagccgagatcgtgccactgcactccagcctgggcgacagagcgagactccgtctcaaaaaaaaaaaaaaagaaagaaaagaaaataggccaatatggtgaaaccctttctctactaaaaatacaaaaattagccaagcgtgacggtgcctgcctgtagtcctagctacttgggaggttgagacaggagaatcgcttgaagcctggaggcggaggttgcagtgagctcacgccactgcaccccagcctgggcaacaagagtgaaactctgtctccaaaaaaaaaaaaaaaaaaaaaaagtatatcacatatgtagcatgtgtttacaagtttaaaaggcaccacctatgcactcatcactcaagagaatatcaataactttctcagttttttttcattgttatagtctgtattcaataaaattacccagatcttaactaggcagtttgataaatcctgacaaatgtaaacactcatgttaccatcacccaaattaagatattgtaaaacattttcattactctagaaagttcactcatgcctctctccagtcactacccctgaggcagccactgtgctgatttcccatcaccatacattagttgtacctagccttgaacttcatagaaatagagtcatacatacttccttgtctgccttgtttctcaacatgatgttttgaaattcatccatgttgcacctaacagtaatgagtcgtaatttattaatgagtagtagtgtattgtacaaatttgtttattcgttctcttgttggtatttggattgtttccagtttgggactattgttaataaacctgtgaatctgcaagccta

SEQ ID NO: 107584 - DNA, 2250 bp, Homo sapiens
  Payload ID: 1110
  Gene Symbol: ANKRD12
  Gene Name: ankyrin repeat domain 12
  ENST ID: ENST00000359158
  CDS Start-End: 1-292
ttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagaatatttattttccacatggtgaatgtgcctgaattattgcttggtcaaagtccctcaaggaatgatacaaaaatcatcaattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaa

SEQ ID NO: 107585 - DNA, 2241 bp, Homo sapiens
  Payload ID: 1110
  Gene Symbol: ANKRD12
  Gene Name: ankyrin repeat domain 12
  ENST ID: ENST00000383440
  CDS Start-End: 286-1602
ttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagaatatttattttccacatggtgaatgtgcctgaattattgcttggtcaaagtccctcaaggaatgatacaaaaatcatcaattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatc

SEQ ID NO: 107586 - DNA, 9115 bp, Homo sapiens
  Payload ID: 1110
  Gene Symbol: ANKRD12
  Gene Name: ankyrin repeat domain 12
  Uniprot ID: Q6UB98
  ENST ID: ENST00000400020
  CDS Start-End: 363-6482
cggccgctcgggccgggagcgtcggaggtacccgggtcctgggagaggtggatgaaatcaagaaggggaaattgctgctttagtagtgtccggggaaagagcagccactctacagttctgtcttaaatgccagtgtaaaataaccttgccgcattggacaggcagttcccgtcatcgtttttcaagtacccacttgtgatgcttcaagacccctggagcacgtcaggttcttagatctcgttttgaggagtgatgtggagtgacgcatccttacagatcccaaagcgttgaataaacggttgtacaaagagatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatag

SEQ ID NO: 107587 - DNA, 978 bp, Homo sapiens
  Payload ID: 1110
  Gene Symbol: ANKRD12
  Gene Name: ankyrin repeat domain 12
  ENST ID: ENST00000546007
  CDS Start-End: 48-978
aggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacaattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacag

SEQ ID NO: 107588 - DNA, 390 bp, Homo sapiens
  Payload ID: 1110
  Gene Symbol: ANKRD12
  Gene Name: ankyrin repeat domain 12
  ENST ID: ENST00000577992
  CDS Start-End: 353-390
cctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcgggtccgtacgggtgaggggggcgtggcgacaggaaaggaggaaggaggggcgcggtttcgagcttgtccccggcgccagggaggagatcccctcagttctgcgctgctcccgttccccctccccagagcaagatccaggatgagaagactgataaaagaagaagctagctgaacagctgtaaaatgcccaaatctgggttcacaaaaccaattcagagtga

SEQ ID NO: 107589 - DNA, 631 bp, Homo sapiens
  Payload ID: 1110
  Gene Symbol: ANKRD12
  Gene Name: ankyrin repeat domain 12
  ENST ID: ENST00000581635
  CDS Start-End: 179-427
agatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagaattgacaggataaattttatagttgtaacagaggtaaatcatggcagtgtttactgttgaagattttggaatctgactagtgttgaccctaagccccctacgagcactggcccagtaattagacttctttagaaagaaggtccagaaaagaagaagacaaaaaaggaagctggaaataagaaatccacaccagttagcattctttttggttatccac

SEQ ID NO: 107590 - DNA, 313 bp, Homo sapiens
  Payload ID: 1110
  Gene Symbol: ANKRD12
  Gene Name: ankyrin repeat domain 12
  ENST ID: ENST00000585234
  CDS Start-End: 180-313
tggtgcggggccagacggccgccgccggcttagcgggggaacttcgcctagtcctcgggctgcggtcgcagcgtcattttgcctgagttggatcacgctcgtccacccaccccgtgtaaaaataacagatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacg

SEQ ID NO: 107591 - DNA, 2219 bp, Homo sapiens
  Payload ID: 1111
  Gene Symbol: ANKRD13D
  Gene Name: ankyrin repeat domain 13 family, member D
  Uniprot ID: Q6ZTN6
  ENST ID: ENST00000308440
  CDS Start-End: 512-2068
actgctgcgggggccgcggggggcgcagctggggcgcggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccaggttccgccaaactcctgacaacctgcagctctgcctgaccaggccccgccgccagaccccggctctgcccctgccttccctcctgccccctcctctcccctgccaggacacgcaggccaccctctgccatctccctgcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagc

SEQ ID NO: 107592 - DNA, 2881 bp, Homo sapiens
  Payload ID: 1111
  Gene Symbol: ANKRD13D
  Gene Name: ankyrin repeat domain 13 family, member D
  Uniprot ID: Q6ZTN6
  ENST ID: ENST00000447274
  CDS Start-End: 1176-2732
gacgctggcagccaaccgcagcctctgcaaaagggactcgtgcggcgggcgaaggcagccgttcgccgcgggcggtcctccgccgggacggctctgccgctgcctgggcctgcgcccctctctccccgaactcctatccctgacttcagggccccgggggccgcctccccgcatcgctgggcctgcagacaccggccaggtcccaggggaaggtgcttcccgctcagccggcaagcacttagtggcgtctgctcgttgctcgtctccaggccgggtgaggggagccggggcgccccacttcacccgcacaccccagcagagtcggtgaccgcgggacctggggtaggaagaccggggcgagcaaggggatccgcgggggaaacgcaggcatcacggctgcagcaggaccgcggcccgccgcgcacgcgcgtgcactaccgaggggcccagtgcccgccccctccggccccgccttcctcttccggacccggctccgggggtctgcgcagggctcggggcgcctcctgcgggccgcgggcggagctgtaaccgggcaccgccctccaggccgccccagcggacccgggcccgaccgaggtcggggcgcagacccaaggccgggcatctcctcgggcgctcgcggttgctctgccgcgcgctggcctggccgcggttgccatggttgcggggggacgggggcgcgcgcgaagccccgccccggcccggcgcagccccgcccgctccgccgcccgccccgccctccctgccgcccgcgctgccgccgccgccgccgccgccgctactgctgcgggggccgcggggggcgcagctggggcgcggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgca

SEQ ID NO: 107593 - DNA, 2139 bp, Homo sapiens
  Payload ID: 1111
  Gene Symbol: ANKRD13D
  Gene Name: ankyrin repeat domain 13 family, member D
  Uniprot ID: Q6ZTN6
  ENST ID: ENST00000511455
  CDS Start-End: 171-1988
gccgcccgccccgccctccctgccgcccgcgctgccgccgccgccgccgccgccgctactgctgcgggggccgcggggggcgcagctggggcgcggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagc

SEQ ID NO: 107594 - DNA, 1111 bp, Homo sapiens
  Payload ID: 1111
  Gene Symbol: ANKRD13D
  Gene Name: ankyrin repeat domain 13 family, member D
  Uniprot ID: Q6ZTN6
  ENST ID: ENST00000515828
  CDS Start-End: 192-959
ggagccccagcctgggcccagggaggagggcagcttgggccacgtggccaggacaccagctcccgggggaggcgggcagcggcatctgagcagagcagggcactccaggccaggcagaaggtgggtaaaggcagctgcccacgaaccagagggcagtcctcaatggaagggccaccagccgtgcctcacccatgtcctgtggtcggctgggcaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagca

SEQ ID NO: 107595 - DNA, 2138 bp, Homo sapiens
  Payload ID: 1111
  Gene Symbol: ANKRD13D
  Gene Name: ankyrin repeat domain 13 family, member D
  Uniprot ID: Q6ZTN6
  ENST ID: ENST00000514166
  CDS Start-End: 429-1985
agggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcaggtactgcagaggacaaggggctccccctgaggctggcaggcggggggcagtgagcagccaggcctggggtcatctggagggctcccctcagcagcctggtgcccgcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgttgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagcag

SEQ ID NO: 107596 - DNA, 609 bp, Homo sapiens
  Payload ID: 1111
  Gene Symbol: ANKRD13D
  Gene Name: ankyrin repeat domain 13 family, member D
  ENST ID: ENST00000506119
  CDS Start-End: 1-98
cagccatctcccctgaggagtacttcgaccccaacttcagcctggagtcacggaacattggccgccccatcgagatgtccagcaaagtacagaggtgaggtctgagagctggctggggacttgcctcgggacaagggctcttgcagacccctctctgggcctgtcatagttagggacccactccctcggctggcttctctctggactccactcctggagggcaggagtcatgtctgccttatccatggtcctcagcccttagcaaggggcttggcacagaaaaccggtagtttgtctttgatgaatggatggtgccacccatgtatggttttctattgaatttcatgagtacctgctggggccagcgtggcacagtgggaagggcccccagcgacgtggcctgggagtggagcgtctgccttggtggaacagaacagttacgctcttgcctcgtgaggagccttgagcaggttcaaggcaacactgtggctgagtgaagagcacccgctctccctgggtgaccaggtgacccccatcatcgacctaatggccatcagcaacgctcactttgccaagctgcgcgacttcatcactctgcgccttccacct

SEQ ID NO: 107597 - DNA, 642 bp, Homo sapiens
  Payload ID: 1111
  Gene Symbol: ANKRD13D
  Gene Name: ankyrin repeat domain 13 family, member D
  ENST ID: ENST00000514779
  CDS Start-End: 316-642
ggacacgcaggccaccctctgccatctccctggtcagtccgccgtccttatttcccacagcgattcccaaccctgctcgccctggcagcctccctgccttgccctcttctctcctgccctttgtgagtgtcccgtctcccccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtg

SEQ ID NO: 107598 - DNA, 4148 bp, Homo sapiens
  Payload ID: 1112
  Gene Symbol: ANKRD13A
  Gene Name: ankyrin repeat domain 13A
  Uniprot ID: Q8IZ07
  ENST ID: ENST00000261739
  CDS Start-End: 167-1939
cggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaaggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaattccagtctttgagtctttttccttttcagttttttctagtcactggatgtacccacacttcctgttacgtatgtcagtagaacattagaatgcctcacttcgctcagttcatcactgcaaaggtggcatgctcctcccagccttcctgcccaggttaacaagccccatgctgcttgtttcaaatggcaactaaaagcaagccagtgttgggctgttctgacacctctgtggtcctcctggaggggaactggctcttgtggggtaagggaagcccagccaacatcaaagctctgcatcaatgctatcccttgaagccaactgctttgtgag

SEQ ID NO: 107599 - DNA, 561 bp, Homo sapiens
  Payload ID: 1112
  Gene Symbol: ANKRD13A
  Gene Name: ankyrin repeat domain 13A
  ENST ID: ENST00000551491
  CDS Start-End: 1-252
ctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcg

SEQ ID NO: 107600 - DNA, 904 bp, Homo sapiens
  Payload ID: 1112
  Gene Symbol: ANKRD13A
  Gene Name: ankyrin repeat domain 13A
  ENST ID: ENST00000547639
  CDS Start-End: 1-904
gcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagacaggaacccgctggaatctttgctgggaactgtggaacaccaatttggtgcacaaggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattc

SEQ ID NO: 107601 - DNA, 1455 bp, Homo sapiens
  Payload ID: 1112
  Gene Symbol: ANKRD13A
  Gene Name: ankyrin repeat domain 13A
  ENST ID: ENST00000553025
  CDS Start-End: 303-824
atggggctactggagcagggggaaagaagctggggacaggtagacggaactttccgcgtggagatctttggccaagagaatgagcctcagctctgttctgtgggctgcactgagtttctcggtgtgagctggagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagggttttcagagttctcaagctaactcttttgcaactgacagtgtgtagctgagagagaatttttggaagacagctgctttgttttaatggtgctcagaattaaatgtgtgcttgtcgtgcattgagcaagaattgagccactccttaggattgataccagctacgaaaagaatatagctgctcttgaatgtgaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaaggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggc

SEQ ID NO: 107602 - DNA, 640 bp, Homo sapiens
  Payload ID: 1112
  Gene Symbol: ANKRD13A
  Gene Name: ankyrin repeat domain 13A
  ENST ID: ENST00000547419
  CDS Start-End: 1-521
cgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaatcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaact

SEQ ID NO: 107603 - DNA, 3214 bp, Homo sapiens
  Payload ID: 1113
  Gene Symbol: ANKRD13B
  Gene Name: ankyrin repeat domain 13B
  Uniprot ID: Q86YJ7
  ENST ID: ENST00000394859
  CDS Start-End: 155-2035
cgcgccgcccccgcccgccgccgctcgcacatgcccgagccgcagccccgcgagcaggcagcgccggccccccgccccgcggccccgggccccggctccggcgccgtccctcctccccggccgggcgccgcggccccggcatgaggagcgggcgatgatccccgccaacgcctccgccaggaaggggcccgagggcaagtatccgctgcactacctcgtgtggcacaaccgccaccgcgagctggagaaggaggtccgcgcgggccaggtggacatcgagcagctggatccccgcggccggactcccctgcacctggccaccacgctggggcaccttgagtgtgcccgtgtgctcctggcgcacggcgcagacgtgggcagggagaatcgcagcggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgttcactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggagtcccatcccccaaggcacatttttttttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccgga

SEQ ID NO: 107604 - DNA, 2671 bp, Homo sapiens
  Payload ID: 1113
  Gene Symbol: ANKRD13B
  Gene Name: ankyrin repeat domain 13B
  Uniprot ID: Q86YJ7
  ENST ID: ENST00000488766
  CDS Start-End: 155-2035
cgcgccgcccccgcccgccgccgctcgcacatgcccgagccgcagccccgcgagcaggcagcgccggccccccgccccgcggccccgggccccggctccggcgccgtccctcctccccggccgggcgccgcggccccggcatgaggagcgggcgatgatccccgccaacgcctccgccaggaaggggcccgagggcaagtatccgctgcactacctcgtgtggcacaaccgccaccgcgagctggagaaggaggtccgcgcgggccaggtggacatcgagcagctggatccccgcggccggactcccctgcacctggccaccacgctggggcaccttgagtgtgcccgtgtgctcctggcgcacggcgcagacgtgggcagggagaatcgcagcggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccgga

SEQ ID NO: 107605 - DNA, 543 bp, Homo sapiens
  Payload ID: 1113
  Gene Symbol: ANKRD13B
  Gene Name: ankyrin repeat domain 13B
  ENST ID: ENST00000579719
  CDS Start-End: 1-387
gaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggtcagtgcccgctgggccggagagaatcctccggagaggatcctgtctcccctaagccaggacacagccggagaacccgcggggccctcggcagggaccctcctggtatcgggatggcttctgccaccactcctgcctccgaggcggcaggcaggggtcagggatccaggcttcaccgcggagttcagactctccccaggcattgacgggg

SEQ ID NO: 107606 - DNA, 582 bp, Homo sapiens
  Payload ID: 1113
  Gene Symbol: ANKRD13B
  Gene Name: ankyrin repeat domain 13B
  ENST ID: ENST00000583728
  CDS Start-End: 377-582
gcttaaaggggccgcggcagatgcccggccccggcgggcagcgtggcctgcggccctggcctccgctgcagcgctcgcctggcccggaggcaatgtggacatcgagcagctggatccccgcggccggactcccctgcacctggccaccacgctggggcaccttgagtgtgcccgtgtgctcctggcgcacggcgcagacgtgggcagggagaatcgcagcggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccg

SEQ ID NO: 107607 - DNA, 2670 bp, Homo sapiens
  Payload ID: 1113
  Gene Symbol: ANKRD13B
  Gene Name: ankyrin repeat domain 13B
  Uniprot ID: Q86YJ7
  ENST ID: ENST00000614878
  CDS Start-End: 155-2035
cgcgccgcccccgcccgccgccgctcgcacatgcccgagccgcagccccgcgagcaggcagcgccggccccccgccccgcggccccgggccccggctccggcgccgtccctcctccccggccgggcgccgcggccccggcatgaggagcgggcgatgatccccgccaacgcctccgccaggaaggggcccgagggcaagtatccgctgcactacctcgtgtggcacaaccgccaccgcgagctggagaaggaggtccgcgcgggccaggtggacatcgagcagctggatccccgcggccggactcccctgcacctggccaccacgctggggcaccttgagtgtgcccgtgtgctcctggcgcacggcgcagacgtgggcagggagaatcgcagcggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggtgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccgg

SEQ ID NO: 107608 - DNA, 3327 bp, Homo sapiens
  Payload ID: 1114
  Gene Symbol: ANKRD13C
  Gene Name: ankyrin repeat domain 13C
  Uniprot ID: Q8N6S4
  ENST ID: ENST00000262346
  CDS Start-End: 327-1847
ctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagttacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctg

SEQ ID NO: 107609 - DNA, 4069 bp, Homo sapiens
  Payload ID: 1114
  Gene Symbol: ANKRD13C
  Gene Name: ankyrin repeat domain 13C
  Uniprot ID: Q8N6S4
  ENST ID: ENST00000370944
  CDS Start-End: 315-1940
gagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaatgaa

SEQ ID NO: 107610 - DNA, 1567 bp, Homo sapiens
  Payload ID: 1115
  Gene Symbol: ANKRD16
  Gene Name: ankyrin repeat domain 16
  Uniprot ID: Q6P6B7
  ENST ID: ENST00000191063
  CDS Start-End: 553-1467
ggggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtgggcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgttt

SEQ ID NO: 107611 - DNA, 1646 bp, Homo sapiens
  Payload ID: 1115
  Gene Symbol: ANKRD16
  Gene Name: ankyrin repeat domain 16
  Uniprot ID: Q6P6B7
  ENST ID: ENST00000380092
  CDS Start-End: 518-1603
cggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtgggcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgtttccaagaggaggcaataaagtgcatggtaattcata

SEQ ID NO: 107612 - DNA, 2738 bp, Homo sapiens
  Payload ID: 1115
  Gene Symbol: ANKRD16
  Gene Name: ankyrin repeat domain 16
  Uniprot ID: Q6P6B7
  ENST ID: ENST00000380094
  CDS Start-End: 545-1630
aggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtgggcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcagggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaaaaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaaaaaaaagacatttcatctaagccacttaacaccgtgtctgatgtgtagtaaataataaatgtcaatgattctcaaagaacccaggaatagaaaaagcatttaataaaaattagctcttggcataatctcttcatccac

SEQ ID NO: 107613 - DNA, 7734 bp, Homo sapiens
  Payload ID: 1116
  Gene Symbol: ANKRD17
  Gene Name: ankyrin repeat domain 17
  Uniprot ID: O75179
  ENST ID: ENST00000330838
  CDS Start-End: 131-7189
agtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataa

SEQ ID NO: 107614 - DNA, 10784 bp, Homo sapiens
  Payload ID: 1116
  Gene Symbol: ANKRD17
  Gene Name: ankyrin repeat domain 17
  Uniprot ID: O75179
  ENST ID: ENST00000358602
  CDS Start-End: 118-7929
gaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtatatatcaatttgtcttctttttttttaattagacataaaatttcacactggtaaaacataaaaactaactaaaattcatataaatcacctagagttgatgatattaacatggttccttggttgtcaagtaaatcaaatgatttcttccatctgagtaaagagtaaagcctgagtaaagagtaaaaagatgacttctcaaacatatccagaaatttgtaaacagtacactcatatcttttagtttaagaagtggtcttaaaatatataaatttgtttttccacctatgtttaatatgcccaaatttaaagggagagctaaaagacagcctacaaataaatatagctatgaaataaaattatagcactttactaaaaaagggatgtaataatgttatttaacgaagtattttatatatgacttgccactattctatacataaaattttttttcttaattctttcctgtgttaactagggttattttctatttaaggtaatcctgctggagaacagatgctatccaatatttattacaacacatgagttgtgttgtttcacaatactgaatttcttaggtgaggtattttatttaaaaaggagggggaaaactcctatattttcttgacttcaaacctgtggggccaggggatatagattgaaatgctccgtatttagtcttggggatcaggcttgtttagtacaataccatggttttagaagtctgtactaggaacatttttaaaatacattttttatatttcagatgtaatgcagtgcacttttatttgaacaataaaaaaacccataactttttgagaccatgaaggtcttttattttttaattttgaaaatatgtggtatgtgtatatgcagactacatcattgttttaagaaatgatttaactcttggacattacacttgggttagttcacaccttaaatccccaagtagttaatatctcaattattgtataatcagtttataccatccattcccaacaaaattccacatttcatgccttttcaacatacatttcaacataatcaacatatttacaaacactgacttcactgtttataaagaagaaatttcccctcctatttcccattactgaaaagtcaagtcatttttattgatacatgaaaattaatttttttgtaaatgactacgtatagtcatttttctcctttggaaaaggtaaatagcttattaactaatcctgtcttgttcttcacaaaaataatagtccatccgtgttttgactcaaataacctaaatacacattttgtaaaaattttgtaccctatattacttatttttaaaacagtacagtgttagactaaacaggaaaactcaaagttataaaatctcttcagatcctctagtttattaaatctattttcatgttga

SEQ ID NO: 107615 - DNA, 8105 bp, Homo sapiens
  Payload ID: 1116
  Gene Symbol: ANKRD17
  Gene Name: ankyrin repeat domain 17
  Uniprot ID: O75179
  ENST ID: ENST00000509867
  CDS Start-End: 88-7560
tcctgttcccttgctgacacagaggagtgttcctgctggcaatgatctaatcatagtgcagtaagaaacatggcagtttgataaaacatggtggagacagcggctgaaatggaagcatatgttctagaagacattcttgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataa

SEQ ID NO: 107616 - DNA, 2717 bp, Homo sapiens
  Payload ID: 1116
  Gene Symbol: ANKRD17
  Gene Name: ankyrin repeat domain 17
  ENST ID: ENST00000561029
  CDS Start-End: 131-2717
agtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaa

SEQ ID NO: 107617 - DNA, 8456 bp, Homo sapiens
  Payload ID: 1116
  Gene Symbol: ANKRD17
  Gene Name: ankyrin repeat domain 17
  ENST ID: ENST00000558247
  CDS Start-End: 1-7463
gcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtact

SEQ ID NO: 107618 - DNA, 4041 bp, Homo sapiens
  Payload ID: 1117
  Gene Symbol: ANKRD18A
  Gene Name: ankyrin repeat domain 18A
  Uniprot ID: Q8IVF6
  ENST ID: ENST00000399703
  CDS Start-End: 376-3354
ggcttccggagtcccggctggcgctgagttgtaggcgcgcgcctaactggcatcgcggggactcactcggtctgagagttcggagcgctgaggttcaggcgcgcgcctaacggcttagctgggctcactcggtctgagaggtcggagtctgcgagtgtcgctgctgaaggctgtggtggaccgggctggatcgcggattctgagctacattgcgggtttgggggtggatcttggatttgggggtggatcgcgggttgcgggggggatcgcgggttgcgggggagatcgcggatttggggcggagtgggggtggaaaggccacgaggagccgccgcggctcaggagcgggtggtgggcgtctgagaagtcgccaccatgaggaagctcttcagcttcgggagacgcctgggccaggcgctcctgagctccatggaccaagagtatgcgggtccgggttacgacattcgggactgggaactgcggaagatccacagggctgccatcaagggcgacgccgcggaggtggagcgctgcctgacgcgcaggttccgggacttggacgcccgcgacagaaaagacaggactgttctacatttggcctgtgcccatggccgtgtgcaagtggtcactctcttgctgcacagaagatgccagatcgacatctgtgacagactaaacaggacacctttaatgaaggctgtacacagccaggaagaggcttgtgccatcgttctcctggaatgtggcgccaatccaaacattgaggatatctacggcaacactgctctccattatgccgtgtataataaggggacttcactggcagaaagactgctttcccaccatgcaaatattgaagcactaaacaaggagggaaacactccacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacgtatctcttctcaagacatgtttggccaaactgccgaggattatgctctttgttctgatttgagaagcatccgacaacaaattttggaacataaaaataaaatgcttaaaaatcatcttcgaaatgacaatcaagaaacagcagctatgaagcctgcaaatttgaaaaaaagaaaagaacgtgcaaaagcagaacacaacctaaaagtggcttcagaggaaaagcaagaaaggctccaaagaagtgaaaataaacagccacaggattctcaaagttacggaaaaaagaaggatgcgatgtatggaaattttatgttgaagaaagacattgccatgctcaaagaggaattatatgcaataaaaaatgacagtctcagaaaggaaaagaaatatattcaggaaattaaaagcattacagaaataaatgctaactttgaaaagagtgtaagactcaatgaaaaaatgataacaaaaacagtggcccggtattcgcaacagcttaatgatctgaaagctgagaatgcaaggctgaattcagaattggagaaggaaaaacacaacaaagaaagactagaagctgaagttgaatccctccattctagcctggccactgctataaatgagtacaatgaaattgtggaaagaaaagacctagaactagttttatggagagcagatgatgtttctagacatgaaaaaatgggttctaatatttctcaactaacagataagaatgagttgcttactgaacaggtccataaagctcgggtgaagttcaataccttaaaaggtaagctccgtgagacaagagatgctctcagggaaaagacattggctttaggaagtgtacagctggacctaaggcaagcacagcatcgaataaaggaaatgaagcagatgcatccaaatggagaagctaaagaaagtcaatccattggaaagcagaactctttagaggagagaatacgtcaacaagaacttgaaaatctcttgcttgaacgacaactagaggatgctcgtaaggaaggcgataataaagagatagtcattaatatccacagagactgtcttgagaatggaaaggaagatcttctagaagaaagaaataaggaattaatgaaagaatataattatttaaaagaaaaactgcttcagtgtgaaaaagaaaaagcagaaagagaagtgattgtgagagaatttcaagaagaactggtcgatcaccttaaaacattttcaatatcagagtctccactggaaggtacatcacattgtcatattaatttgaatgagacatggacttcaaagaagaaattatttcaagtagaaattcaacctgaagaaaaacatgaagaattcagaaaactttttgaattaatatcattactgaactatactgcggaccaaataagaaagaaaaatcgtgaattagaagaagaggcaactggatataagaaatgcctagaaatgacaataaatatgttaaatgcatttgcaaatgaggacttcagttgccatggagacttaaatacagaccaactgaaaatggatattctgtttaagaagctaaaacagaagtttaatgatcttgtggccgagaaggaagctgtgtcttcagaatgtgtcaatttggccaaagacaatgaagttcttcatcaggagttattatctatgagaaatgtacaagagaaatgtgaaaaacttgagaaggataaaaagatgttggaagaagaagtattaaatcttaagacacatatggaaaaagatatggtagaacttggtaaactacaagaatataaatcggagctggatgaaagggcagtgcaggaaatagaaaaattagaagaaatccatttacagaaacaagcagaatatgaaaaacaattagagcagttaaacaaggataatacggcttcactaaaaaagaaggaactcacacttaaagatgtggaatgtaaattctccaaaatgaaaactgcttatgaagaggttacaactgaattagaagaatttaaggaagcctttgcaggagcagtgaaagctaacaattccatgtcaaaaaaattaatgaaatcggataagaaaatagcagtgatcagcaccaagctctttacggagaaacagcggatgaaatattttctcagcactcttcctacaaggccagaaccagagttaccttgtgttgaaaatcttaatagtatagaactcaacagaaaatatattcccaaaacggccataagaattcctacttcaaacccacagacttcaaataactgcaagaacttcttgactgaggttttgctatgttgagcacttgctcccgtctactttcttttgtagaatccactggtaagccacatctaatgaagagattaaccataaaatcttaaggaaaagttgtatgatttaaaagatcataaaactttattactgggctatttacatgaaattttaattgtttctcatataatataaaacatcataatctttactaaagtagaatattttcatgtcacatatggtgtatatttatatgttattttaaatgatgttttttagcctccttaagttttaagtggatcttgcaaatgaacaccagcgttattgagtttggcctactcaaattgcctgaatgtcagctgtttaaacagccaaacaaccaagtcatcattgatactttagtaaaggtcatcgagggcttctttgcattttacagtttttattaccatatgtagtaggagacttaaagagtatctgccaggtttgtccatactagtgttacggttttcttcttgtagctcaatagtattttgtgtggagatactttgaagctctgtaaatatctggttactcctcaaaacccactagatttagcatttcatggatgacttgtgtttgaacaagtattactgtgatggttgccagatgattgtttttcttattttcttctttgttctacatggagaaataaaaccaataaataaaggagaagggaaa

SEQ ID NO: 107619 - DNA, 2906 bp, Homo sapiens
  Payload ID: 1117
  Gene Symbol: ANKRD18A
  Gene Name: ankyrin repeat domain 18A
  ENST ID: ENST00000602295
  CDS Start-End: 1-1206
gaaaaagaaaaagcagaaagagaagtgattgtgagagaatttcaagaagaactggtcgatcaccttaaaacattttcaatatcagagtctccactggaaggtacatcacattgtcatattaatttgaatgagacatggacttcaaagaagaaattatttcaagtagaaattcaacctgaagaaaaacatgaagaattcagaaaactttttgaattaatatcattactgaactatactgcggaccaaataagaaagaaaaatcgtgaattagaagaagaggcaactggatataagaaatgcctagaaatgacaataaatatgttaaatgcatttgcaaatgaggacttcagttgccatggagacttaaatacagaccaactgaaaatggatattctgtttaagaagctaaaacagaagtttaatgatcttgtggccgagaaggaagctgtgtcttcagaatgtgtcaatttggccaaagacaatgaagttcttcatcaggagttattatctatgagaaatgtacaagagaaatgtgaaaaacttgagaaggataaaaagatgttggaagaagaagtattaaatcttaagacacatatggaaaaagatatggtagaacttggtaaactacaagaatataaatcggagctggatgaaagggcagtgcaggaaatagaaaaattagaagaaatccatttacagaaacaagcagaatatgaaaaacaattagagcagttaaacaaggataatacggcttcactaaaaaagaaggaactcacacttaaagatgtggaatgtaaattctccaaaatgaaaactgcttatgaagaggttacaactgaattagaagaatttaaggaagcctttgcaggagcagtgaaagctaacaattccatgtcaaaaaaattaatgaaatcggataagaaaatagcagtgatcagcaccaagctctttacggagaaacagcggatgaaatattttctcagcactcttcctacaaggccagaaccagagttaccttgtgttgaaaatcttaatagtatagaactcaacagaaaatatattcccaaaacggccataagaattcctacttcaaacccacagacttcaaataactgcaagaacttcttgactgagatggagctggaccgtgtagaacaaataattacaggaacaaagaaaagtatgttgccaaaatgtattaattaaatttaggtttattttagtaataaagtgtaaatagcaaatggcattccttttcattgttgggttagtagatactatattcagtatctttttcttacacacatctaatgaaagatgtgaaaacgaaaactttcacagtgaagagtatacttatgcatcattaattcatcatgttccatagcttaaaaaattcccaagaagtggatccatctcttttttaccagctctacaatttgttcacttttgccatcctcatggaactgtcagccagcacactgaaacgattctccaaaaacaaaggcatcagttggcttacatctgttctcaggaaaagttccaaaaatttcaccatgaaataaaaacactcacatcaatgtaactcttgtcaggttactcagccttgtctctcaccacttactgcattctgccctttgctctagcaccaaagtggacagaatagagctccgcagggctctttgttacctcaggatctttgccttcgcctcttccctctatctggcaagattttcctcgtccttcagtcatcaacctatgtatcccctccaccagaaagcccatgatattgacacaaaagtgggatagatgtcccttctgtatgttccagtagtgccctgctgtatacctgtcatggtatctatgactctatatggacattacctgccggtcttttaggttatagcatatgactattgggaggtggaccatgccatcttcatcttgtaattccagtgctggctctagtaccttagcacgtggctgttgagtacatgaatgaagaatgaaaaagctgtgatatttaaccacaattggaattaacgccatgtgtaaatgatttaatagtaattttgtattgtaattgcacgtacatatttctcattcttattaactctgataacgttctcaactccacattttaaacttacacttcgttaactgaaatgttttaggtaaagaacataatcctttctttttctttccaggttttgctatgttgagcacttgctcccgtctactttcttttgtagaatccactggtaagccacatctaatgaagagattaaccataaaatcttaaggaaaagttgtatgatttaaaagatcataaaactttattactgggctatttacatgaaattttaattgtttctcatataatataaaacatcataatctttactaaagtagaatattttcatgtcacatatggtgtatatttatatgttattttaaatgatgttttttagcctccttaagttttaagtggatcttgcaaatgaacaccagcgttattgagtttggcctactcaaattgcctgaatgtcagctgtttaaacagccaaacaaccaagtcatcattgatactttagtaaaggtcatcgagggcttctttgcattttacagtttttattaccatatgtagtaggagacttaaagagtatctgccaggtttgtccatactagtgttacggttttcttcttgtagctcaatagtattttgtgtggagatactttgaagctctgtaaatatctggttactcctcaaaacccactagatttagcatttcatggatgacttgtgtttgaacaagtattactgtgatggttgccagatgattgtttttcttattttcttctttgttctacatggagaaataaaaccaataaataaaggagaagggaaa

SEQ ID NO: 107620 - DNA, 3773 bp, Homo sapiens
  Payload ID: 1118
  Gene Symbol: ANKRD18B
  Gene Name: ankyrin repeat domain 18B
  Uniprot ID: A2A2Z9
  ENST ID: ENST00000290943
  CDS Start-End: 97-3132
gggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggactgttctacatttggcctgtgcccatggccgtgtgcaagtggtcactctcttgctggacagaaaatgccagatcaacatctgtgacagactaaacaggacacctttaatgaaggctgtacactgccaggaagaggcttgtgccattattctcctgaaacgtggcgccaatccaaacattaaggatatctacggcaacactgctctccattatgccgtgtataatgaggggacttcactggcagaaagactgctttcccaccatgcaaatattgaagcactaaacaaggagggaaacactccacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacatatctcttctcaagacatgtttggccaaactgccgaggattatgctttttgttgtgatttgagaagcatccaacaacaaattttggaacataaaaataagatgcttaaaaatcatcttcgaaatgacaatcaagaaacagcagctatgaagcctgaaaatttgaaaaaaagaaaaaaaagaaaaaaattgaaaaaaagaaaagaaggtgcaaaagcagaacacaacttaaaagtggcttcagaggaaaagcaagaaaggcttgaaagaagtgaaaataaacagccgcaggattctcaaagttatggaaaaaagaaggatgagatgtttggaaattttatgttgaagagagacattgccatgctcaaagaggaattatatgcaataaaaaatgacagtctcagaaaggaaaagaaatatattcaggaaattaaaagtattacagaaataaatgctaactttgaaaagagtgtaagactcaatgaagaaatgataacaaaaaaagtggcccagtattcgcaacagcttaatgatctgaaagctgagaatgcaaggctgaattcaaaattggagaaggaaaaacacaacaaagaaagactagaagctgaagttgaatccctccattctaacttggccactgctataaatgagtacaatgaaattttggaaagaaaagacctagaactagttttatggagagcagatgatgtttctagacatgaaacaatgggttctaatatttctcaactaacagataagaatgagttgcttactgaacaggtccataaagctcgggtgaagttcaataccttaaaaggtaagctccgtgagacaagagatgctctcagggaaaagacattggctttagaaagtgtacagctggacctaaagcaagcgcagcatcgaataaaggaaatgaagcagatgcatccaaatggggaagctaaagaaagtcaatccattggaaagcagaactcttcagaggagagaatacgtcaacgagaacttgaaaatctcttgcttgaacgacaactagaggatgctcgtaaggaaggtgataataaagagatagtcattaatatccacagagactgtcttgagaatggaaaggaagatcttctagaagaaagaaataaggaattaatgaatgaatataattatttaaaagaaaaactgcttcagtatgaaaaagaaaaagcagaaagagaagtgattgtgagagaatttcaagaagaactggtcgatcatcttaaaaaattttcaatgtcagagtctccactggaaggtacatcacattgtcatattaatttggatgagacatggacttcaaagaagaaattatttcaagtagaaattcaacctgaagaaaaacatgaagaattcagaaaagtttttgaattaatatcattactgaactatactgcggatcaaataagaaagaaaaatcgtgaattagaagaagaggcaactggatataagaaatgcctagaaatgacaataaatatgttaaatgcatttgcaaatgaagacttcagttgccatggagacttaaatacagaccaactgaaaatggatattctgtttaagaagctaaaacagaagtttgatgatcttatggccgagaaggaagctgtatcttcaaaatgtgtcaatttggccaaagacaatgaagttcttcatcaggagttattatctatgggaaaagtacaagagaaatgtgaaaaacttgagaaggataaaaagatgttggaagaaaaagtattaaatcttaagacacatatggaaaaagatatggtagaacttggtaaagtacaagaatataaatcggagctggatgaaagggcaatgcaggcaatagaaaaattagaagaaatccatttacagaaacaagcagaatatgaaaaacaattagagcagttaaacaaggataatacggcttcactaaaaaagaaggaactcacacttaaagatgtggaatgtaaattctccaaaatgaaaacagcttatgaagatgttacaactgaattagaagagtataaggaagcctttgcagtagcattgaaagctaacagttccatgtcagaaaaaataacgaaatcggataagaaaatagctgtgatcagcaccaagctctttatggagaaagagcggatggaatattttctcagcactcttcctatgaggccagacccagagttaccttgtgttgaaaatcttaatagtatagaactcaacagaaaatatattcccaaaatggccataagaattcctacttcaaacccacagacttcaaataactgcaagaactccttgactgagcttttgctgcgttgggcccttgctcctatctactttcttctctagaatccactggtaagccacatctaatgaagagaatatttaaccataaaatcttaaggaaaagttgtatgatttaaaagatcataaaactttattactgggctatttacatgaaattttaattgtttctcataaaatataaaacatcacaatctttactaaagtagaatattttcatatcatatgatgtatatttatatgttattttaaatgatttttttagcctccttaagttttaagtggatcttgcaaatgaacaccagtgttattgagtttgacctactcaaattgcctgaatgtcagctgtttaaacagccaaacaaccaagtcatcattgatactgtagtaaaggtcatctttgcattttacactttttattaccatatatagtaggagacttaaagagtatctgccaggtttgtccatactagtgttatgattttctttttgtagttcaatagtattttgtgtggagatactttgaagctctgtaaatatctggttactcctcaaaacccactagatttagcatttcatggatgacttgtgtttgaacaagtattactgtgatggttgccagatgattatttttcttattttcttctttgttctacatggagaaataaaaccaataaataaaggag

SEQ ID NO: 107621 - DNA, 2898 bp, Homo sapiens
  Payload ID: 1118
  Gene Symbol: ANKRD18B
  Gene Name: ankyrin repeat domain 18B
  ENST ID: ENST00000357927
  CDS Start-End: 1-1206
gaaaaagaaaaagcagaaagagaagtgattgtgagagaatttcaagaagaactggtcgatcatcttaaaaaattttcaatgtcagagtctccactggaaggtacatcacattgtcatattaatttggatgagacatggacttcaaagaagaaattatttcaagtagaaattcaacctgaagaaaaacatgaagaattcagaaaagtttttgaattaatatcattactgaactatactgcggatcaaataagaaagaaaaatcgtgaattagaagaagaggcaactggatataagaaatgcctagaaatgacaataaatatgttaaatgcatttgcaaatgaagacttcagttgccatggagacttaaatacagaccaactgaaaatggatattctgtttaagaagctaaaacagaagtttgatgatcttatggccgagaaggaagctgtatcttcaaaatgtgtcaatttggccaaagacaatgaagttcttcatcaggagttattatctatgggaaaagtacaagagaaatgtgaaaaacttgagaaggataaaaagatgttggaagaaaaagtattaaatcttaagacacatatggaaaaagatatggtagaacttggtaaagtacaagaatataaatcggagctggatgaaagggcaatgcaggcaatagaaaaattagaagaaatccatttacagaaacaagcagaatatgaaaaacaattagagcagttaaacaaggataatacggcttcactaaaaaagaaggaactcacacttaaagatgtggaatgtaaattctccaaaatgaaaacagcttatgaagatgttacaactgaattagaagagtataaggaagcctttgcagtagcattgaaagctaacagttccatgtcagaaaaaataacgaaatcggataagaaaatagctgtgatcagcaccaagctctttatggagaaagagcggatggaatattttctcagcactcttcctatgaggccagacccagagttaccttgtgttgaaaatcttaatagtatagaactcaacagaaaatatattcccaaaatggccataagaattcctacttcaaacccacagacttcaaataactgcaagaactccttgactgagatggagctggactgtgcagaacaaataattacagaaacaaagaaaagtatgttgccaaaatgtattaattaaatttaggtttattttagtaataaagtgtaaatagcaaatggcattccttttcattgttgggttagtagatactacattcagtatctttttcttacacacatctaatgaaagatgtgaaaacaaaaactttcacagtgaagagtatacttatgcatcattaattcatcatgttccatagcttaaaaaattcccaagaagtggatccatctcttttttactgattctgcaatttcttcacttttgccgtcctcatggaactgtcagccagcacactgaaacgattctccaaaaacaaaagcatcaattggcttacatctgttctcaggaaaagttccagaaatttcaccatgaaataaaaacacccatgtcaatgtaattcttgtcaggttactcagccttgtctctcaccacttactgcattctgccctttgctctagcaccaaagtggacagagtagaactccgcagggctctttgttacctcaggatctttgccttcgcctcttccctctttctggcaagattttcctcatccttcagtcatcaacctatgtatcccctccaccagaaagcccatgatattgacacaaaagtgggatagatgtcccttctgtgtgttccagtagtgccccgctgtatacctgtcatgatatctatgactctatatggacattacctgccggtcttttaggttatagcatatgactattgggaggtggaccatgccatcttcatcttgtaattccagtgctggctctagtaccttagcacgtggctgttgagtgcatgaatgaagaatgaaaaagctgtgatatttaaccacaattagaattagtgccatgtgtaaatgatttaatagtaatcttgtattgtaattgcacgtacatatttctcattcttattaactctgataatgttctcaactctacattttaaacttacacttcgttaactgaaatgttttaggtaaagaacataatcctttctttttctttccagcttttgctgcgttgggcccttgctcctatctactttcttctctagaatccactggtaagccacatctaatgaagagaatatttaaccataaaatcttaaggaaaagttgtatgatttaaaagatcataaaactttattactgggctatttacatgaaattttaattgtttctcataaaatataaaacatcacaatctttactaaagtagaatattttcatatcatatgatgtatatttatatgttattttaaatgatttttttagcctccttaagttttaagtggatcttgcaaatgaacaccagtgttattgagtttgacctactcaaattgcctgaatgtcagctgtttaaacagccaaacaaccaagtcatcattgatactgtagtaaaggtcatctttgcattttacactttttattaccatatatagtaggagacttaaagagtatctgccaggtttgtccatactagtgttatgattttctttttgtagttcaatagtattttgtgtggagatactttgaagctctgtaaatatctggttactcctcaaaacccactagatttagcatttcatggatgacttgtgtttgaacaagtattactgtgatggttgccagatgattatttttcttattttcttctttgttctacatggagaaataaaaccaataaataaaggagaagggaaa

SEQ ID NO: 107622 - DNA, 668 bp, Homo sapiens
  Payload ID: 1118
  Gene Symbol: ANKRD18B
  Gene Name: ankyrin repeat domain 18B
  ENST ID: ENST00000465094
  CDS Start-End: 1-483
aaacaagcagaatatgaaaaacaattagagcagttaaacaaggataatacggcttcactaaaaaagaaggaactcacacttaaagatgtggaatgtaaattctccaaaatgaaaacagcttatgaagatgttacaactgaattagaagagtataaggaagcctttgcagtagcattgaaagctaacagttccatgtcagaaaaaataacgaaatcggataagaaaatagctgtgatcagcaccaagctctttatggagaaagagcggatggaatattttctcagcactcttcctatgaggccagacccagagttaccttgtgttgaaaatcttaatagtatagaactcaacagaaaatatattcccaaaatggccataagaattcctacttcaaacccacagacttcaaataactgcaagaactccttgactgaggttagttatatgaccatttctcttttgggtttcatttctctaatataattcttgtttataatttggtgaaatactgagttgttctgttgacttatgcatgttaagtaaagattataattagctgtgttaacacagaaaggaaatggaaactttacattttttaattccctggagctctcattttcaagagacacccatttgctaactttattcaataaatgtggttaaactga

SEQ ID NO: 107623 - DNA, 223 bp, Homo sapiens
  Payload ID: 1118
  Gene Symbol: ANKRD18B
  Gene Name: ankyrin repeat domain 18B
  ENST ID: ENST00000605687
  CDS Start-End: 1-223
acaaattttggaacataaaaataagatgcttaaaaatcatcttcgaaatgacaatcaagaaacagcagctatgaagcctgaaaatttgaaaaaaagaaaaaaaagaaaaaaattgaaaaaaagaaaagaaggtgcaaaagaacacaacttaaaagtggcttcagaggaaaagcaagaaaggcttgaaagaagtgaaaataaacagccgcaggattctcaaagt

SEQ ID NO: 107624 - DNA, 1350 bp, Homo sapiens
  Payload ID: 1119
  Gene Symbol: ANKRD2
  Gene Name: ankyrin repeat domain 2 (stretch responsive muscle)
  Uniprot ID: Q9GZV1
  ENST ID: ENST00000298808
  CDS Start-End: 210-1193
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataaggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgct

SEQ ID NO: 107625 - DNA, 1449 bp, Homo sapiens
  Payload ID: 1119
  Gene Symbol: ANKRD2
  Gene Name: ankyrin repeat domain 2 (stretch responsive muscle)
  Uniprot ID: Q9GZV1
  ENST ID: ENST00000307518
  CDS Start-End: 210-1292
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgct

SEQ ID NO: 107626 - DNA, 1451 bp, Homo sapiens
  Payload ID: 1119
  Gene Symbol: ANKRD2
  Gene Name: ankyrin repeat domain 2 (stretch responsive muscle)
  ENST ID: ENST00000370655
  CDS Start-End: 291-1292
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaa

SEQ ID NO: 107627 - DNA, 1072 bp, Homo sapiens
  Payload ID: 1119
  Gene Symbol: ANKRD2
  Gene Name: ankyrin repeat domain 2 (stretch responsive muscle)
  ENST ID: ENST00000455090
  CDS Start-End: 11-913
agaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataaggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaa

SEQ ID NO: 107628 - DNA, 3379 bp, Homo sapiens
  Payload ID: 1120
  Gene Symbol: ANKRD20A1
  Gene Name: ankyrin repeat domain 20 family, member A1
  Uniprot ID: Q5TYW2
  ENST ID: ENST00000562196
  CDS Start-End: 281-2752
caggcgcgcgcccaacggctttgcgaggctcactcggtctgagaggtcggaggctgcgagtgtcgctgctgaaggctgtggtggaccgggctggatcgcggattgtggagtagaccatagatttgaaatagcggagttggggttggatcggggctttggggttggataggggatttggggctgggtcggccggggtcggggaggggggtggtgaaaaggtgacagggagctgcccccgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagaactgctctacacttggcctgtaccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaagaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtggaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaattgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagctgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagacaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaa

SEQ ID NO: 107629 - DNA, 586 bp, Homo sapiens
  Payload ID: 1120
  Gene Symbol: ANKRD20A1
  Gene Name: ankyrin repeat domain 20 family, member A1
  ENST ID: ENST00000620792
  CDS Start-End: 30-586
ggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagaactgctctacacttggcctgtaccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaagcagtgtgtccccgagaaagtgtcagagcctttacctggatcttcgcatgaaaaaggaaacagaat

SEQ ID NO: 107630 - DNA, 1398 bp, Homo sapiens
  Payload ID: 1120
  Gene Symbol: ANKRD20A1
  Gene Name: ankyrin repeat domain 20 family, member A1
  ENST ID: ENST00000619063
  CDS Start-End: 265-552
ggctttgcgaggctcactcggtctgagaggtcggaggctgcgagtgtcgctgctgaaggctgtggtggaccgggctggatcgcggattgtggagtagaccatagatttgaaatagcggagttggggttggatcggggctttggggttggataggggatttggggctgggtcggccggggtcggggaggggggtggtgaaaaggtgacagggagctgcccccgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagggaattctttcaaatcaaatcatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttaaagttgctgattacttttcaaagtactcatttgaaaatgaactgctctacacttggcctgtaccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaagaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcaggtaggattttatagatttaaaaaattatgttaactaagaaaatatagatggaagaaatgagtatctgttgagtgttgtattctg

SEQ ID NO: 107631 - DNA, 3511 bp, Homo sapiens
  Payload ID: 1121
  Gene Symbol: ANKRD20A2
  Gene Name: ankyrin repeat domain 20 family, member A2
  Uniprot ID: Q5SQ80
  ENST ID: ENST00000377601
  CDS Start-End: 113-2584
ggggatttggggctgggtcggccggggtcggggagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaggaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtagaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataattttta

SEQ ID NO: 107632 - DNA, 520 bp, Homo sapiens
  Payload ID: 1121
  Gene Symbol: ANKRD20A2
  Gene Name: ankyrin repeat domain 20 family, member A2
  ENST ID: ENST00000611747
  CDS Start-End: 81-509
gagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaa

SEQ ID NO: 107633 - DNA, 1398 bp, Homo sapiens
  Payload ID: 1122
  Gene Symbol: ANKRD20A3
  Gene Name: ankyrin repeat domain 20 family, member A3
  ENST ID: ENST00000614733
  CDS Start-End: 265-552
ggctttgcgaggctcactcggtctgagaggtcggaggctgcgagtgtcgctgctgaaggctgtggtggaccgggctggatcgcggattgtggagtagattatagatttgaaatagcggagttggggttggatcggggctttggggttggataggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacaggaaattctttcaaatcaaatcatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttgaagttgctgattacttttcaaagtactcatttgaaaatgaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaggaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcaggtaggattttatagatttaaaaaattatgttaactaagaaaatatagatggaagaaacgaatatctgttgagtgttgtattctg

SEQ ID NO: 107634 - DNA, 3964 bp, Homo sapiens
  Payload ID: 1122
  Gene Symbol: ANKRD20A3
  Gene Name: ankyrin repeat domain 20 family, member A3
  Uniprot ID: Q5VUR7
  ENST ID: ENST00000611388
  CDS Start-End: 113-2584
ggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcctggcgcgcaggagcggagacctggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaggaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtagaagatcctgctgtgaaaggagcagtacaaagaaagaatgtacagacattgagagcagaacaagccttaccagtggcttcagaggaagagcaagaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaattatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagacaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaa

SEQ ID NO: 107635 - DNA, 4137 bp, Homo sapiens
  Payload ID: 1123
  Gene Symbol: ANKRD20A4
  Gene Name: ankyrin repeat domain 20 family, member A4
  Uniprot ID: Q4UJ75
  ENST ID: ENST00000357336
  CDS Start-End: 282-2753
gcaggcgcgcgcccaacggctttgcgaggctcactcggtctgagaggtcggaggctgcgagtgtcgctgctgaaggctgtggtggaccgggctggatcgcggattgtggagtagattatagatttgaaatagcggagttggggttggatcggggctttggggttggataggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagaactggacgccctggacaagcagcacagaactgctctacacttggcctgtgccagtggccatgtgcaagtggtcactctcctggttaacagaaaatgccagattgatgtctgtgacaaagaaaacagaacgcctttgatacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggacaataataccccacttttatttgctataatttgcaagaaagagaaaatggtggaatttttattgaaaaagaaagcaagttcacatgccgttgataggctgagacggtcagctctcatgcttgctgtatactatgactcaccaggtattgtcaatatccttcttaagcaaaatattgatgtcttcgctcaagacatgtgtggacgagatgcagaagattatgctatttctcatcatttgacaaaaattcaacaacaaattttggaacataaaaagaagatacttaaaaaggagaaatcagatgttggaagttctgatgaatctgcagtcagcattttccatgaactgcgtgtggattcattgcctgcatcggatgacaaagacttgaatgttgctactaagcagtgtgtccccgagaaagtgtcagagcctttacctggatcttcgcatgaaaaaggaaacagaatagtcaatggacaaggagaagggcctcctgcaaaacatccttccttgaagcctagcactgaagtggaagatcctgctgtgaaaggagcagtacaaagaaagaatgtacagacattgagagcagaacaagccttaccagtggcttcagaggaagagcaacaaaggcatgaaagaagtgaaaagaagcaaccacaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgatagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaattgggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacaagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacaacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacttcgtgctagaagagaaaagtaagaagctaatgaatgaatgtgatcatttaaaagaaagtctctttcagtatgagagagagaaaacagaagtagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaactttaagttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtactgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtatttttatgaccacgtaatgttttaaaggcacctactggttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcatcaaaggccattggaattttacttttattctgagataggaatctgttggaaggatttgaacaggtgattgaatatgttaggaactttgaggctgagttgagcttctgagatgattgaatgttggaatgaatctgttgtgtaaaagagaataccaatttggcaggaagagaacatattctgcatccctcactgaattcagtaataaataaaaatgtgtacatgtgattaaaagaaggtgaa

SEQ ID NO: 107636 - DNA, 520 bp, Homo sapiens
  Payload ID: 1123
  Gene Symbol: ANKRD20A4
  Gene Name: ankyrin repeat domain 20 family, member A4
  ENST ID: ENST00000615302
  CDS Start-End: 81-509
gaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagaactggacgccctggacaagcagcacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaa

SEQ ID NO: 107637 - DNA, 1596 bp, Homo sapiens
  Payload ID: 1124
  Gene Symbol: ANKRD22
  Gene Name: ankyrin repeat domain 22
  Uniprot ID: Q5VYY1
  ENST ID: ENST00000371930
  CDS Start-End: 212-787
attgggctgggctctctggaaggtgtgctgctgcctgagctgctggaaaagcactgacaggtgtttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatcagaatgactttggacaagtgtggcggtgggtgaaagaagacagcagctatgccaacgttcaagatggctttaatggagacacgcccctgatctgtgcttgcaggcgagggcatgtgagaatcgtttccttccttttaagaagaaatgctaatgtcaacctcaaaaaccagaaagagagaacctgcttgcattatgctgtgaagaaaaaatttaccttcattgattatctactaattatcctcttaatgcctgttctgcttattgggtatttcctcatggtatcaaagacaaagcagaatgaggctcttgtacgaatgctacttgatgctggcgtcgaagttaatgctacagattgttatggctgtaccgcattacattatgcctgtgaaatgaaaaaccagtctcttatccctctgctcttggaagcccgtgcagaccccacaataaagaataagcatggtgagagctcactggatattgcacggagattaaaattttcccagattgaattaatgctaaggaaagcattgtaatccttgtgaccacaccgatggagatacagaaaaagttaacgactggattctatcttcattttagacttttggtctgtgggccatttaacctggatgccaccattttatggggataatgatgcttaccatggttaatgttttggaagagctttttatttatagcattgtttactcagtcaagttcaccatggccgtaatccttctaagggaaacactaaagttgttgtagtctccacttcagtcagaaactgatgtttcagctaggcacagtggtacatgcctgtaatcccagctacttgggaggctgaggtgggaggatcacttgaactcaggagtttgagagcagccagggcaacacagcgagaccctgtctcaaaaaaaaaaaaaaaaaaaaaagccctggtgttccaaactcagtctttcctgaagaagaggatctgagttatcttctgaaacagcgttctcccttcccagttgtatcactcttataaaaagactgtccagtctatgtcatgccctaggagacaaactgttcctcccagccccctttgagtattgagcagaagaatcaaattattaaatacgtatgtttgtacagaatggtatttgtgtatgtgtgtgggcttagagattcacaagtaaatattcctttggtgaaggaatttcaataaaaacatctatcaagtgtcagcggtgagtgtgtttacaccacagaaattggcaaattgacaaatcagagtttgtttttgtttttttgttttttactttccataaagttcgtttaccagcataccactagagatttcggt

SEQ ID NO: 107638 - DNA, 2597 bp, Homo sapiens
  Payload ID: 1125
  Gene Symbol: ANKRD23
  Gene Name: ankyrin repeat domain 23
  Uniprot ID: Q86SG2
  ENST ID: ENST00000318357
  CDS Start-End: 43-960
ttcagctcttctcactggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 107639 - DNA, 2455 bp, Homo sapiens
  Payload ID: 1125
  Gene Symbol: ANKRD23
  Gene Name: ankyrin repeat domain 23
  Uniprot ID: Q86SG2
  ENST ID: ENST00000331001
  CDS Start-End: 30-821
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatt

SEQ ID NO: 107640 - DNA, 2156 bp, Homo sapiens
  Payload ID: 1125
  Gene Symbol: ANKRD23
  Gene Name: ankyrin repeat domain 23
  Uniprot ID: Q86SG2
  ENST ID: ENST00000418232
  CDS Start-End: 14-931
aacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatta

SEQ ID NO: 107641 - DNA, 3711 bp, Homo sapiens
  Payload ID: 1126
  Gene Symbol: ANKRD24
  Gene Name: ankyrin repeat domain 24
  Uniprot ID: Q8TF21
  ENST ID: ENST00000262970
  CDS Start-End: 1-3711
atgcagccggcggcctgcgctggtgagggagccgggcccccggcgccgcgtcctcctcatcctccaggcgacaaggtcaggaggggccggggcggcgccccttccctcagcccccagcccccagccccctacctgggtcttcccattccatcccgtgggggagggggctggcgaggagggcaagggggagggggcggcaccagggagggcgggaccgggcgggcgggcggggcggggagctccggcagcgcccagccccgccctccggccgctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctga

SEQ ID NO: 107642 - DNA, 3906 bp, Homo sapiens
  Payload ID: 1126
  Gene Symbol: ANKRD24
  Gene Name: ankyrin repeat domain 24
  Uniprot ID: Q8TF21
  ENST ID: ENST00000318934
  CDS Start-End: 157-3597
ctaggggccaggactggtcaggaaggaggaagcggtccttttgaggagggcgaggcaacggaccctgccgcccaccaggactggtgtccctcaccttacccccacccttgccctcctcaggtggcctgtggagaggagaaacacagggcaccaactatgaagactctcagggcgcgatttaagaagacagagctgcggctcagccccactgaccttggctcctgcccgccctgcggcccctgccccatcccgaagccggcagccagaggcaggcgccagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacaggg

SEQ ID NO: 107643 - DNA, 2524 bp, Homo sapiens
  Payload ID: 1126
  Gene Symbol: ANKRD24
  Gene Name: ankyrin repeat domain 24
  ENST ID: ENST00000597689
  CDS Start-End: 6-2524
caactatgaagactctcagggcgcgatttaagaagacagagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcac

SEQ ID NO: 107644 - DNA, 4026 bp, Homo sapiens
  Payload ID: 1126
  Gene Symbol: ANKRD24
  Gene Name: ankyrin repeat domain 24
  Uniprot ID: Q8TF21
  ENST ID: ENST00000600132
  CDS Start-End: 277-3717
gtggcctggaggactcatttaagaatcatgtgttgagtacctactttgtactgggcacactggagagcaaaggtggtaccatctatgccctggtggctgcgggtggacacaaacatgtgaccaggggccaggactggtcaggaaggaggaagcggtccttttgaggagggcgaggcaacggaccctgccgcccaccaggactggtgtccctcaccttacccccacccttgccctcctcaggtggcctgtggagaggagaaacacagggcaccaactatgaagactctcagggcgcgatttaagaagacagagctgcggctcagccccactgaccttggctcctgcccgccctgcggcccctgccccatcccgaagccggcagccagaggcaggcgccagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacaggg

SEQ ID NO: 107645 - DNA, 736 bp, Homo sapiens
  Payload ID: 1126
  Gene Symbol: ANKRD24
  Gene Name: ankyrin repeat domain 24
  ENST ID: ENST00000595928
  CDS Start-End: 1-491
ctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcagagacagggtctcactgtgttggcccagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctg

SEQ ID NO: 107646 - DNA, 6591 bp, Homo sapiens
  Payload ID: 1127
  Gene Symbol: ANKRD26
  Gene Name: ankyrin repeat domain 26
  Uniprot ID: Q9UPS8
  ENST ID: ENST00000376087
  CDS Start-End: 167-5299
gtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcagaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagatgtgttttatataccttcttgcatgagtggatcaagaaactttaagatggctaaactagaggatacaagaaatgtaggcatgccagtagcccacatggagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgtta

SEQ ID NO: 107647 - DNA, 761 bp, Homo sapiens
  Payload ID: 1127
  Gene Symbol: ANKRD26
  Gene Name: ankyrin repeat domain 26
  ENST ID: ENST00000445828
  CDS Start-End: 1-640
gtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatggaccttctgatgaaacccctcatgactatgttctgatgactgaccaatgtctcacttccaggacagacctgcaatagatgccactggataatgctgagatagactggtgcaggacaaaggacagaactcaaagtcatccctctgctgacctgagacaaatgtgtatctgagtgcttcctccgccctattgtctatgtc

SEQ ID NO: 107648 - DNA, 6827 bp, Homo sapiens
  Payload ID: 1127
  Gene Symbol: ANKRD26
  Gene Name: ankyrin repeat domain 26
  ENST ID: ENST00000436985
  CDS Start-End: 173-5353
acttgtgtctagcgggatcgcttgcttggtaacccggagggagagattggaaaccgcggagtttcctttgggaggctgcggccagccggggctgacttgttatgttgggctccggaggccgttaagagccgagagagacatgaggtgtctctgaagcccggtcgcctgggccatgaagaagatttttagtaagaagggcgagtcgcccttgggctccttcgcgcggcggcagaggagcagcgcgggaggcgggggcgagccgggggagggcgcctactcgcagcccggctaccacgtccgagaccgagatctcggcaagatccacaaagctgccagcgcgggtaatgtggcgaaagtgcagcagatccttttgctcaggaagaatggcttgaacgatagagacaagatgaacaggacggctctacatttggcctgtgccaatggtcatccagaagtagtaactctcctggtggacagaaaatgccagctcaatgtctgtgacaacgaaaacaggacagctctgatgaaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggatgacctcacaccacttttacttgcagtaagtggaaaaaagcagcaaatggtggaatttttaataaagaaaaaagcaaatgtaaatgcagtagataagttggaaagcagtcaccaactaatttcagaatataaagaagaaaggatacctaaacattcttctcaaaatagtaattcagtggatgaaagctctgaagactccttaagcagtttattttattttattttttttgagacaaagtcttgcactgttgcccaggctggagtgctacagcatgatctcagctcactgcaatctctgcttcctgggttcacacaattcttctgcctccacctcccaagtagctgggaccacaggctttctggcaaaccgggtgttgatgattcatggcctacctcagatgacgaagacctcaattttgatactaagaatgtcccaaaaccaagcttagcaaagctaatgactgcttctcagcaatccaggaaaaatttagaagcaacatatggcactgtgagaacaggaaatagaactttgtttgaggatagagattccgatagtcaagatgaagttgtggttgaaagccttcctacaacatcaatcaaagtccagtgcttttctcatcctacctatcaatcacctgaccttcttccaaaaccttcccacaagtcgttagcaaaccctggtcttatgaaggaagaaccaacaaagccaggcattgcaaaaaaagaaaatggtattgatattattgaaagtgctccactagagcaaacaaataatgacaatttgacttatgttgatgaagtgcacaaaaataatagaagtgatatgatgtccgcattaggattaggacaagaggaagatatagaatcaccttgggattctgagagtatctctgagaattttccacagaagtatgttgatcctttagctggggctgcagacggaaaagaaaaaaatataggaaatgaacaagcagaagagtctcctgagagatatcttcacttgaagcctaccattgaaatgaaagattctgttccaaataaagcaggaggaatgaaggatgtacaaacatccaaagcagctgaacatgacttagaagtagcatcagaagaagagcaagaaagggaagggagtgaaaataaccagccacaggttgaagaagaaaggaaaaaacacagaaataatgaaatggaagtatcagcaaacatacatgatggtgctactgatgatgctgaagatgatgatgatgatgatggattaattcaaaaaagaaagagtggagaaactgatcatcagcaatttcccaggaaggaaaataaagagtatgctagtagtggtcctgccttgcaaatgaaggaagtaaagagcactgaaaaagaaaaacggacctcgaaagaatctgtgaattcaccagtgtttgggaaggccagtttactaactggtggcctgctacaagtggatgatgacagcagtttaagtgaaatagatgaggatgaaggaaggcctactaagaaaacatctaatgaaaagaacaaggtcaaaaaccaaatacagtctatggatgatgttgatgacttaactcagtcatctgaaacagcctcagaggattgtgagctaccccactctagttacaagaattttatgttgctcattgaacaacttggaatggagtgtaaagattctgttagcctattgaaaatccaggatgcagctctttcatgtgaaagattattagaacttaaaaaaaatcactgtgaactacttacagtaaaaattaaaaaaatggaagacaaggttaatgtactacaaagggagctatctgaaacaaaagaaataaaatcacagttagagcatcaaaaagttgaatgggaacgagaactgtgctctttgagatttagcttaaaccaagaagaagagaagagaagaaatgctgatacgttgtatgaaaaaattagggaacagttaagaagaaaagaagagcaatataggaaagaagttgaagtgaaacaacagcttgaactgagtctccaaacactggagatggaattgaggactgtaaaaagtaatttgaatcaggtcgttcaagagcgaaatgacgctcagaggcaactttctcgagaacagaatgccagaatgttacaagatggaattctgaccaatcacctttccaaacaaaaggagattgaaatggctcaaaagaaaatgaattctgagaattctcatagtcatgaagaagaaaaagacctatcgcataaaaatagcatgttgcaggaagaaattgctatgctaagactagaaatagacacaataaaaaatcaaaaccaggaaaaagaaaagaaatgttttgaggaccttaaaattgtaaaagaaaagaatgaagaccttcagaagactataaaacagaatgaggaaacattaacacaaacaatatcccagtataatggacggcttagtgttctgacagctgagaatgcaatgctaaattctaaactggagaatgaaaagcaaagcaaggaaagactggaagcagaagttgaatcataccattctagattggctgctgctatacatgatcgtgatcaaagtgagacatcaaaaagagaactagaacttgctttccagagagcaagagatgaatgttctcgtttacaggacaaaatgaattttgatgtgtctaacctaaaagataacaatgagattctttctcaacaactatttaaaactgaaagtaaactcaatagcctagaaattgagttccatcacacgagagatgccctcagagaaaagactttgggtttagaacgggtacaaaaggacctaagccaaacacagtgtcaaatgaaggaaatggaacaaaagtatcaaaatgaacaagttaaagtgaataaatacattggaaagcaggagtctgtagaggagagattgtctcaactacaaagtgagaatatgttgcttcgacaacaactggatgatgcccacaacaaggctgacaataaagagaagacagtgattaatatccaagaccagtttcatgctattgtgcaaaaacttcaagctgagagtgaaaagcaaagtcttctgctagaagaaagaaataaggagttaatcagtgaatgtaatcacttaaaagaaagacagtatcaatatgaaaatgaaaaggcagaaagagaagttgttgtgagacaacttcaacaagaactagctgataccctaaaaaaacaatctatgtcagaggcttcactggaggttacgtcacgttatcgtattaatttagaagatgagacacaggatttaaagaagaaattaggtcaaatcagaaatcaattgcaagaagcacaggatcgacatacagaagctgtcagatgtgctgagaagatgcaagatcacaagcaaaagcttgaaaaagataatgccaagttaaaagttacagtcaaaaagcaaatggacaaaattgaggagcttcagaaaaacctgttaaatgcaaatttgtctgaagatgaaaaggaacaattaaagaaacttatggaattaaaacagtcactggaatgtaatttggatcaagaaatgaagaaaaatgttgaattagaaagagagataactggatttaagaacctcttaaaaatgacaagaaagaagttaaatgaatatgaaaatggagaatttagtttccatggagatttaaaaactagtcaatttgaaatggatattcagattaataagctaaaacataagattgatgatcttacagcagaactggagactgcaggttcaaaatgtctacatctggatacaaagaaccaaattcttcaagaggagttgttatctatgaaaacagtacaaaagaaatgtgaaaaactacagaagaataaaaagaagttggaacaagaagtgatcaacctgagaagtcatatagaaaggaatatggtagaacttggtcaagtcaaacagtataaacaggagattgaagaaagagcaagacaggaaatagcagaaaaattaaaagaagtcaatctatttttacaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaaaactaatgagaggctagcagaggtcaacaccaaacttcttgtggaaaaacagcagagcagatctttgttcaccactctcactaccaggccagtcatggagccaccttgtgtgggaaatcttaataatagtttagatctcaacagaaaacttattccaagagaaaacttagtgatctctacctcaaatccacgggcttcaaataatagcatggagaactacttgagcaagatgcagcaggagttggaaaaaaatataactagagaactcaaagaagctgctgctgaattggaatctggatcaatagcttcccctctagggtctactgatgagtcaaatctaaatcaagatctagtttggaaagcatcaagagaatatgtacaggttttaaagaaaaattatatgatctgaaagataagattttattactgggctgtttatgtgacattttgtttctcattaaatattaatatatgacatgtaaaaatattaaaggaacgtatttttgtatcatatatgtcagatcaaaatttatatagtattttaaacaatgttacttggcttctttaacttttaagtggattttgccaatgaaaaccaggaatattgagttttacatactcaaactgcccaaatgtgagctgtttaaacagccaaaccactaagttgtcattaatactttagtgcagttaattgatggcttatttgtattttgtaatttttatcactatatgtagtggtagatgtctaattggacttagacatcattttgttgtgcaggaactgtggtcattgttcatgtttggatgtattacaattgttacagtgccatcaaatttacataattttaattttaagcactgatttatatagctgttctcagggagaaacaagatttgcctgattcaccttttctgtttgtttatttatttttaattaaccttttggaaatagccttcagtttagagaaaatttcgaagttttagtacaaagactttctcctccgaacaatttgagagtaaattgctgacattatgtcatcacccctgattactttagtgggcattcctacaagtcaggacattctacataactacagtgcaaaccttgcaatcagaaagtcaacattaatacattctagtttgttacttctctgtaatgtcctttatagcaaaaggatcccattctaatccatggcttgtatttagttgttgtatctgttagatctttcagtctggaacagttcctcagtctttccttgaccttcatgaccttgaatattttgaagagtaaagtctggtaatataagaatgtccctcaattgggtttcatggtgattagatttagattatatgattttttggcaggagtatcacagaagtgacccagtgatcttctcattgcatcttacctgtgaccctacagttttgatttgccctgttactggtaatgttagcattgatcactaacagtggtatctgctgaatttctcctctgtaatgttattttttcaccttgtggttaattagtattttacagggaggtaatttgagactatgtacatatctctactccccatcgaaccctcaatttattcatttgcttgtatcaaataaaccatggattcatggtttattttattcagtgagttataattcattaatattgttattaaaaatttgtttttcttttaagaaatgttatattttgacaacttcagacttacagaaagattataagaggtagtacaaataatttttggatattattccccaaatgttaacattttactgcatttactttatcctttctcccccttctcctcctgtctttctagatgaatatgaatataggtacttaatacagattttttttctaaactgtt

SEQ ID NO: 107649 - DNA, 4450 bp, Homo sapiens
  Payload ID: 1128
  Gene Symbol: ANKRD27
  Gene Name: ankyrin repeat domain 27 (VPS9 domain)
  Uniprot ID: Q96NW4
  ENST ID: ENST00000306065
  CDS Start-End: 160-3312
ggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggagccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccagctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcggaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccccctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttg

SEQ ID NO: 107650 - DNA, 628 bp, Homo sapiens
  Payload ID: 1128
  Gene Symbol: ANKRD27
  Gene Name: ankyrin repeat domain 27 (VPS9 domain)
  ENST ID: ENST00000591100
  CDS Start-End: 106-628
tggaggcaagtgaggatgcggcctttaacaaaatcacaagaagccttcaagatcttcagcagaaagatattggtgtgaaaccggagttcagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacc

SEQ ID NO: 107651 - DNA, 1067 bp, Homo sapiens
  Payload ID: 1128
  Gene Symbol: ANKRD27
  Gene Name: ankyrin repeat domain 27 (VPS9 domain)
  ENST ID: ENST00000590519
  CDS Start-End: 843-1067
gcggccgccgcggcgcgtgcagcgggaacgcggcgcccagctccagcgcgcgtcgcatgtccgcttccagcaggtccaggcagcccgagaaggccacccagagccgctcgaactcggcgcgctcgtcggcggccaggccccggtcgcgcagcacagcagtcagccgggcgcaggtggacaccgccagctcctgcgccttctggcgcgtcttttgcagctcctgccgcaggttctgcgagtccgccgagccaccgacggtcagcaccaggtggtggtagcacgcagtcgtcttgttgagcccgtccagcagcgccttgcactcctccctcgccatcgcggtgggctccggctgggcccggccgcccgcgcccgttagcctccccctcagcgcggcaggatgtggctaacccccatcccggccttgggccgcgcggcacgaacgctcttcatggtccgtgactcgctcggcgctaccgccaacgtccacggagcccgcccgggaccctcgacgtgcgcctctgcggacggggcgcgcagagggagccccgttagcggtcccccgctccctcgtccatcctccccaggcgcactccgagtcacacgtcgtgtctctgcaccgccctggcctccacggtggctccctgcgaagctgagggtgcggtccccatcctccgtgggtgccaactccggggcaagcaggctgcagagccgcgcgctccgccttaggcgctgccaagggcggccgggtagggtttcctaggacccgcccaccccgctcgtcccggccggagctgccaccccctggatcagtggagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttatt

SEQ ID NO: 107652 - DNA, 3301 bp, Homo sapiens
  Payload ID: 1128
  Gene Symbol: ANKRD27
  Gene Name: ankyrin repeat domain 27 (VPS9 domain)
  ENST ID: ENST00000587352
  CDS Start-End: 130-1299
gccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgtaagatctcacccctgccctggccttcctttgtgggcatcatggttcccttgatagggtgctggggttggtatgtgggcagacggattcttaaattgcctcccaggaatggggcctcagctgtttgagggctgtgagtcttaaaaatcactcagtgaagagaacaccaagccctcaattggtggtaaaaattggtgggttatcattgggatttacattgttaatatcctacttcattagtccccatcctctccaaagacatgtgggtgcaaagggaagccagaagtagggaatttggatttcttgaccttgatagtcaagaagtgatgtcacgggatccctggactgtcgcttttccagccggaaacctctgtggctggtggctcctttgcctgagttttgttcgggcctgctgggctcatttcacgctcttggcctggcaggctgcgctcggcttgtgctactggcctggatcccatgcctgccaagggcgagccaggtgtggagtggcgaggggtatgtgagcaagtgcagggtctggccactgcacacaaccaggtgtgccgactgaggtggggtgggcagctccaagttgcttgtacagggtcctgctccatgcaaggctgcagctagagcaggcgtactgtaggccgcttccacggtgggcactggggaacacagtggggcctggaagcttggagacaccaggaactgcagagccccaaagagggtgtcatagccctggctcggggaactcctaggttgggctccctgaagggccagagctcttctctcctctcgtcacctgcaatgtagtgagtcgggagcatgttttagctctctttatgttacagctctttcagtcctgccatttggtgggtcccgagttcttgtcccatgtcgaggaagaatgaggtacgtagactagtggagggtgagcaaggcagagaggagctttactgaacggcagaatagctctcaggagacccacagtgggcagcttctttccacaggcaggtcgtcctgacgagttaaagaggcctgacgtaggtagctccttcctgcagttggtagtcccgacatctgtctgagtctggctgagtccggggttttttatggctcagaagggagggagtatgtgctgattggtccataggtgggcctggagaaagcaccatgagttctcagtctgggtcgtggactccacttgggactgacagcccggcccccaggctttaggctgtccctgtcttgaaggtggggcttcactgggcacctgcacctttccacccagaagcgtgtctgccttctgccaccatcaacatgctggccagtgcatccaggctgtttgtgccaaggggcatctgcaggcctgcactgagctgccctcagcccctaccttgactactctcccatgctcatcagcgcccaaaatcttggaggggtctgaggcatcaggaggctggtgtgtcagtgtcacaccaagcatgtgcacacatggctgggttgcaacagtacccgggcttggcctcagctttgctctgaaattgaagtcggtgccaggagtggggaggagcgggagcaggcacttacgagcctgcggcggcagggatgcttcctgggcccctgagagtgcagagattcctggatccagagctgcggctgggcggctgcagctgcgcctgggagtgcagggctcccgccctgccagctcagtaggagatgggggctcctgcctgttcctggctcctgttggccctgcagagtgcacaaacctggccgcgcttcctccactgcagcttacgtctttgcagcagccactcccgatgggctgccactgccatctgtgagaccattaatgtgtgcaatttgaggactcagtggccttgccattgtttccttggtttttattgagcattggctggggtcggcgaggggatgtgattatatttctatgtgaatcgtgagaatcttgaaccatggttgtcctgctggcctgttttactacataccaatgagtaaaatgtgatcatacagaaatcacaaagttgaaatc

SEQ ID NO: 107653 - DNA, 773 bp, Homo sapiens
  Payload ID: 1128
  Gene Symbol: ANKRD27
  Gene Name: ankyrin repeat domain 27 (VPS9 domain)
  ENST ID: ENST00000588700
  CDS Start-End: 153-401
ggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagt

SEQ ID NO: 107654 - DNA, 743 bp, Homo sapiens
  Payload ID: 1128
  Gene Symbol: ANKRD27
  Gene Name: ankyrin repeat domain 27 (VPS9 domain)
  ENST ID: ENST00000586463
  CDS Start-End: 652-743
gggctatagggccagatcgccgcgcgagggtggtgggcatcgaggtcccagcagcggacgagggaggtgccgccgtcgcccaggatgggctgggaatgaagcgatgtagccttttaagtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcag

SEQ ID NO: 107655 - DNA, 557 bp, Homo sapiens
  Payload ID: 1128
  Gene Symbol: ANKRD27
  Gene Name: ankyrin repeat domain 27 (VPS9 domain)
  ENST ID: ENST00000586693
  CDS Start-End: 108-557
cgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagagcctttggcaccctcagatcccttttccctgaaaaccattgaagatgtgagagagttcttgggaagacactccgagcga

SEQ ID NO: 107656 - DNA, 3300 bp, Homo sapiens
  Payload ID: 1128
  Gene Symbol: ANKRD27
  Gene Name: ankyrin repeat domain 27 (VPS9 domain)
  ENST ID: ENST00000622502
  CDS Start-End: 130-654
gccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgtaagatctcacccctgccctggccttcctttgtgggcatcatggttcccttgatagggtgctggggttggtatgtgggcagacggattcttaaattgcctcccaggaatggggcctcagctgtttgagggctgtgagtcttaaaaatcactcagtgaagagaacaccaagccctcaattggtggtaaaaattggtgggttatcattgggatttacattgttaatatcctacttcattagtccccatcctctccaaagacatgtgggtgcaaagggaagccagaagtagggaatttggatttcttgaccttgatagtcaagaagtgatgtcacgggatccctggactgtcgcttttccagccggaaacctctgtggctggtggctcctttgcctgagttttgttcgggcctgctgggctcatttcacgctcttggcctggcaggctgcgctcggcttgtgctactggcctggatcccatgcctgccaagggcgagccaggtgtggagtggcgaggggtatgtgagcaagtgcagggtctggccactgcacacaaccaggtgtgccgactgaggtggggtgggcagctccaagttgcttgtacagggtcctgctccatgcaaggctgcagctagagcaggcgtactgtaggccgcttccacggtgggcactggggaacacagtggggcctggaagcttggagacaccaggaactgcagagccccaaagagggtgtcatagccctggctcggggaactcctaggttgggctccctgaagggccagagctcttctctcctctcgtcacctgcaatgtagtgagtcgggagcatgttttagctctctttatgttacagctctttcagtcctgccatttggtgggtcccgagttcttgtcccatgtcgaggaagaatgaggtacgtagactagtggagggtgagcaaggcagagaggagctttactgaacggcagaatagctctcaggagacccacagtgggcagcttctttccacaggcaggtcgtcctgacgagttaaagaggcctgacgtaggtagctccttcctgcagttggtagtcccgacatctgtctgagtctggctgagtccggggttttttatggctcagaagggagggagtatgtgctgattggtccataggtgggcctggagaaagcaccatgagttctcagtctgggtcgtggactccacttgggactgacagcccggcccccaggctttaggctgtccctgtcttgaaggtggggcttcactgggcacctgcacctttccacccagaagcgtgtctgccttctgccaccatcaacatgctggccagtgcatccaggctgtttgtgccaaggggcatctgcaggcctgcactgagctgccctcagcccctaccttgactactctcccatgctcatcagcgcccaaaatcttggaggggtctgaggcatcaggaggctggtgtgtcagtgtcacaccaagcatgtgcacacatggctgggttgcaacagtacccgggcttggcctcagctttgctctgaaattgaagtcggtgccaggagtggggaggagcgggagcaggcacttacgagcctgcggcggcagggatgcttcctgggcccctgagagtgcagagattcctggatccagagctgcggctgggcggctgcagctgcgcctgggagtgcagggctcccgccctgccagctcagtaggagatgggggctcctgcctgttcctggctcctgttggccctgcagagtgcacaaacctggccgcgcttcctccactgcagcttacgtctttgcagcagccactcccgatgggctgccactgccatctgtgagaccattaatgtgtgcaatttgaggactcagtggccttgccattgtttccttggtttttattgagcattggctggggtcggcgaggggatgtgattatatttctatgtgaatcgtgagaatcttgaaccatggttgtcctgctggcctgttttactacataccaatgagtaaaatgtgatcatacagaaatcacaaagttgaaatc

SEQ ID NO: 107657 - DNA, 6074 bp, Homo sapiens
  Payload ID: 1129
  Gene Symbol: ANKRD28
  Gene Name: ankyrin repeat domain 28
  Uniprot ID: O15084
  ENST ID: ENST00000383777
  CDS Start-End: 341-3040
gactgtgtcttcacaacgttagacctctcttcagctgcattgctggctgcctagagccctagactaatgagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 107658 - DNA, 6564 bp, Homo sapiens
  Payload ID: 1129
  Gene Symbol: ANKRD28
  Gene Name: ankyrin repeat domain 28
  Uniprot ID: O15084
  ENST ID: ENST00000399451
  CDS Start-End: 369-3530
gcggccgcgggggctgccagggtatttcgggaagggggcgtgaggaggcggcggcggcagcggcgggtagggcaggcagcagagggaaggagaaagaaaggaaggaagagggcggggagtcctcagaggaggaggcgggaccggccgggcacctcacctctcggcggcggcggcggcggcggcggcggcgggcggccggggaggcggcgccgccccctgcccgcaggtcttctcagcgcagtcggccgcggacccgctggtcccgggcagcggccaaggctactggggcgggagcagtgggccggtcggcggcggcagcggcagcggcggaggaggaggaggctggagtgggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 107659 - DNA, 592 bp, Homo sapiens
  Payload ID: 1129
  Gene Symbol: ANKRD28
  Gene Name: ankyrin repeat domain 28
  ENST ID: ENST00000439830
  CDS Start-End: 67-111
cggtcggcggcggcagcggcagcggcggaggaggaggaggctggagtgggcgcggaggcgaccgccatggcgttcctcaaactccgtgaccaggcctgtgattggaattgaaacagtacaactgcctccaccagaggaaaatagtatgggaattcctattatgccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacat

SEQ ID NO: 107660 - DNA, 2485 bp, Homo sapiens
  Payload ID: 1129
  Gene Symbol: ANKRD28
  Gene Name: ankyrin repeat domain 28
  ENST ID: ENST00000451422
  CDS Start-End: 182-2350
attgttgttttggaggaggtagaagatgaatctcctgcattcatttctaaattgccacaggaaaataaatccctacattctccaccttctggaaatgtattggtaagatatccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatgaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcag

SEQ ID NO: 107661 - DNA, 4408 bp, Homo sapiens
  Payload ID: 1129
  Gene Symbol: ANKRD28
  Gene Name: ankyrin repeat domain 28
  Uniprot ID: O15084
  ENST ID: ENST00000412318
  CDS Start-End: 20-3181
gggcgcggaggcgaccgccatggcgttcctcaaactccgtgaccagccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaat

SEQ ID NO: 107662 - DNA, 6383 bp, Homo sapiens
  Payload ID: 1129
  Gene Symbol: ANKRD28
  Gene Name: ankyrin repeat domain 28
  Uniprot ID: O15084
  ENST ID: ENST00000624145
  CDS Start-End: 650-3349
ctgttagtcagcagaggcagtacaccagatttccttgtggcttttagtggaaaatgttaaaagcgcactcatttttcagttatagaattttttagtttgatttggattagtcacagaactggcatgaaccttctaattgtgaaggctgtccaaatgcactatttttttctcctgctagaggaagttacatcccgagaagtagctcagatctctgccatcactggtgcaagctatatttaacggagatcctgatgaagttcgagcactaatatttaagaaagaagatgttaactttcaggacaatgaaaagcgaaccccattgcacgccgcagcttaccttggagatgcagaaatcattgaacttcttattttatctggagctagagttaatgccaaagacagcaaatggttgacacctttacacagagcagttgcatcttgtagtgaggaagcagttcaggtacttttgaagcattctgcagatgttaatgctcgagacaaaaattggcaaacccctttacatatagctgctgctaataaagctgtaaagtgtgctgaagctttggtacctcttctgagtaatgtaaacgtatctgatcgagcagggaggactgcattacatcatgcagctttcagtggacatggtgagatggtcaaactactcttgtctagaggtgccaatattaatgcttttgacaagaaagataggcgtgctatccattgggcagcatatatgggtcacattgaagtagtgaaattgcttgtgtcgcatggagctgaagtgacatgcaaggataaaaagtcttatacacctcttcatgcagcagcctctagtggaatgatcagcgtagtcaagtaccttctagatcttggagttgatatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaagagtaaagatgggaaaaccccactacacatgactgctctccacggtagattctcccgatcacaaaccattatccagagtggagctgtaatcgactgtgaggataagaatggaaatacccctttgcacatagcagcacggtatggccatgagctgctgatcaacactcttattacaagtggtgctgacactgcaaagcgtggcatacatggaatgttccccctccatttggcagccttaagcggcttttcagattgctgcagaaaacttctttcttcaggatttgatatagataccccagatgattttggcaggacttgtctacatgcagctgcagctggagggaatttggagtgcctaaaccttctgctgaatactggtgcagactttaataaaaaggacaaatttgggagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtgcctggaatacttattaagaaacgatgcaaatccagggatccgtgataagcaaggatacaacgcagttcattattcagctgcttatggtcaccgtctatgtcttcagctgattgcaagtgaaactcctctagatgttttaatggaaacctcaggaacagacatgctgagtgattcagataatagagcaacaataagccctttacacttggctgcctatcatggtcaccatcaagcactggaagtgttggtacagtctttgttagatcttgatgtcagaaatagtagtggaagaacacccctagatcttgcagcttttaagggccatgttgaatgtgtggatgtactcattaatcagggagcctcaatcttagtaaaagattacattttgaagaggacacctattcatgcagcagcaacaaatggtcattcagaatgcttacggctattaataggaaatgcagaaccacagaatgcagtggatattcaagatggaaatggacagacgcctctgatgctatctgttctcaacgggcacacagactgtgtttactcattgctgaacaaaggagcaaatgtagatgccaaagataagtggggaaggacagcgttgcatagaggggcagttacaggccatgaagaatgtgtagatgcattacttcaacatggtgctaagtgcttacttcgggatagcaggggccggacgcctatacacctgtctgctgcctgtggacacattggtgttcttggagcccttttgcagtcagcagcatctatggatgcaaatccagccacagcagacaatcatggatatacggcacttcactgggcttgctacaatggtcacgagacatgtgtagaactgcttttagaacaggaagttttccagaaaacggaaggaaatgcttttagtccattgcattgtgccgtgataaatgacaacgaaggtgctgctgagatgttaattgatacattaggtgccagcattgtgaacgccacagattcaaaaggaagaactcctctccatgcagccgccttcacagaccatgtagagtgtttacagctgctgctcagccataatgctcaagtcaattctgtggactctacagggaaaacacctcttatgatggctgcagaaaatggacaaacaaatacagttgagatgctggttagcagtgctagtgcagaactgactttacaagataacagtaaaaatactgccctccatttggcttgtagcaagggtcatgaaactagtgccttgttaatactggaaaagataacagatagaaacctcatcaatgcaaccaacgcagccttgcaaacacctctgcatgttgctgcccgaaatgggctaacaatggtggttcaggaacttttgggaaaaggagcaagtgtgcttgcagtagatgaaaatggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgtttattctgatctatgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccaaattgaagactacctttcaaatagcaaaagagagagagaaggctgatatttcggcttttaaataaagatttgtgtggttctgcttttactgtaactgtcactttcccagtgaaaatgatttcatatacattgagggtcttacaggtatgggtaaagttctataaattgcaacaaaatgatacccaatttcattttatcctttttgtattgtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaa

SEQ ID NO: 107663 - DNA, 1658 bp, Homo sapiens
  Payload ID: 1130
  Gene Symbol: ANKRD29
  Gene Name: ankyrin repeat domain 29
  Uniprot ID: Q8N6D5
  ENST ID: ENST00000322980
  CDS Start-End: 86-892
gagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagagtcaggtacaactgccctattctttgccgcccagcaaggccataatgatgtcgtgagatttctctttggatttggagcatccactgaatttaggaccaaagacgggggcaccgccctgttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatat

SEQ ID NO: 107664 - DNA, 583 bp, Homo sapiens
  Payload ID: 1130
  Gene Symbol: ANKRD29
  Gene Name: ankyrin repeat domain 29
  ENST ID: ENST00000586087
  CDS Start-End: 154-583
gcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagaggacgggggcaccgccctgttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcagg

SEQ ID NO: 107665 - DNA, 694 bp, Homo sapiens
  Payload ID: 1130
  Gene Symbol: ANKRD29
  Gene Name: ankyrin repeat domain 29
  ENST ID: ENST00000587763
  CDS Start-End: 1-380
aaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggtgcgatggcagaactgattgggccagattactggtctgggtggtgtcgctgatccatcaagtgcaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctc

SEQ ID NO: 107666 - DNA, 3361 bp, Homo sapiens
  Payload ID: 1130
  Gene Symbol: ANKRD29
  Gene Name: ankyrin repeat domain 29
  Uniprot ID: Q8N6D5
  ENST ID: ENST00000592179
  CDS Start-End: 156-1061
gtgcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagagtcaggtacaactgccctattctttgccgcccagcaaggccataatgatgtcgtgagatttctctttggatttggagcatccactgaatttaggaccaaagacgggggcaccgccctgttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattctataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctaccaaaataaacgcaatggtatttctgctatttaaacacatctttagcttatttcttcatgttctgctctggttttcagtcagtgtctatgtaaagacacttttagaggaaaatgttgtaatcccaaaagaatttttgtttaaccaactttcagagttactaaaaggattatctttaattcagtaaataatagaatataatcttcaaaattagaagatattctcttaaaatttataacaattaatgcaacaaaaatcagcatattttgataaatgtctcaagcaaatgagcaactcacaggccccacaggtgcctacagcctgaccagctatacaaaaagcctgcaacctgattctaggataaaatattagaaagctctctgttgctaaaacatccagatataaacattttggtggctaaaatcaatgccatttcctcattgacattcttttattcagcaaatttgtacaaatatacattttctcctgtgcgaatttcaaaaagctatattcattttgaagaggaaaataatatggcattaaatgctttgtattttccccttagttagcccttatggcaaaaatagttgctaatcactgatacaaagcaaaacgttatgggtactgataacaaagttccaaaagccaaaatgggatgaatcacaaacttactgtttttcactaaaacatgtaattggcctattacatcaatagttttaagtgggtaatgttcttgaacaatattagagccataaaattgaagccagtagcttgaacaatatggaggccttcttactgtagggaagaggtgtctagcttagaaggatcacatttgatctagatgagattacccatagcagggaaaatgaatcatcacctaccaaagactgtacggaaaggtgtgttattttcaaaattgcattttagtttgcacacatgtaaatgattattctatgttaatctaattgacaattcagttagctccgcatcctaagacttaaaactagcaattcctatgcaaatcatctgcttaactgaactacaaacgtttttcattaattcattctttgatgacatattccatgttatataataattcaaaataaagttaatatactacccca

SEQ ID NO: 107667 - DNA, 846 bp, Homo sapiens
  Payload ID: 1130
  Gene Symbol: ANKRD29
  Gene Name: ankyrin repeat domain 29
  ENST ID: ENST00000585908
  CDS Start-End: 43-375
cgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagcgtacggtggttcggtagatgcatgcccagcatgcaccattgccctctgtgggcacaggagcacctcaggaatacattcccctttacaatgcttatttactttttcatgtgtttgcttgctttatcctttttaaaacatccaaggtactgtggtgaacttaaaaacatgctgggggaagtcagaaagaaaaggaaacaatgaaatgcataaaacagaaggcaaccacaatagggaaagaggcacttcactgggaatcagaattggcagattacaagaagaaaagcctgtttagtgaaagaattcaagccaaccacttccatgaaaagatggagataatttagagcacaagtgggctgccatggatgtgggcgttatgtttcttctacaaggatgagaaaacaaaaattgaagcctcccccaggattttatcctttcattacctcttgaaaacataaatacactaattggcaatttaaaaagggaaacaaaaatagatactactgcccactggcagataccacttagagagcttttccatccccagctagaggcaatcgtttttctgtcctcagcaagacttctcatctctgggaccaagaggacctccaatgaggaaagggagcgagcaatgatgttttgattttaggatttgaataaaaatgtttcaaagga

SEQ ID NO: 107668 - DNA, 4405 bp, Homo sapiens
  Payload ID: 1131
  Gene Symbol: ANKRD30A
  Gene Name: ankyrin repeat domain 30A
  ENST ID: ENST00000361713
  CDS Start-End: 100-4125
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccag

SEQ ID NO: 107669 - DNA, 4762 bp, Homo sapiens
  Payload ID: 1131
  Gene Symbol: ANKRD30A
  Gene Name: ankyrin repeat domain 30A
  ENST ID: ENST00000374660
  CDS Start-End: 100-4482
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccag

SEQ ID NO: 107670 - DNA, 4458 bp, Homo sapiens
  Payload ID: 1131
  Gene Symbol: ANKRD30A
  Gene Name: ankyrin repeat domain 30A
  ENST ID: ENST00000602533
  CDS Start-End: 100-4125
ctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccagattgcaccactgcactccagcctgggtgacagagcaagactccatctcaaaaa

SEQ ID NO: 107671 - DNA, 4474 bp, Homo sapiens
  Payload ID: 1131
  Gene Symbol: ANKRD30A
  Gene Name: ankyrin repeat domain 30A
  Uniprot ID: Q9BXX3
  ENST ID: ENST00000611781
  CDS Start-End: 1-4194
atggaggagatctctgccgccgctgtcaaggtcgtgccgggcccggagcgcccgagccctttcagccagctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacgaattgcataaagctgcacaggattcccatctaccctgatgatgcagcagacatcattcaatccaaccag

SEQ ID NO: 107672 - DNA, 4359 bp, Homo sapiens
  Payload ID: 1132
  Gene Symbol: ANKRD30B
  Gene Name: ankyrin repeat domain 30B
  Uniprot ID: Q9BXX2
  ENST ID: ENST00000358984
  CDS Start-End: 181-4359
caagagcttggcgatacagaaatttctgctggtgttggggcgggtgcgggaactgaagacgggcgagtgcgagccgggggcgggtgctggggaagggtaagcgggaagcgagggcgaggggtaggggctggggaagggcgagcgggaggcgcgggctctctctagcagggggctgcagccatgaagaggctcttagctgccgctggcaagggcgtgcggggcccggagcccccgaaccccttcagcgaacgggtctacactgagaaggactacgggaccatctacttcggggatctagggaagatccatacagctgcctcccggggccaagtccagaagctggagaagatgacagtagggaagaagcccgtcaacctgaacaaaagagatatgaagaagaggactgctctacactgggcctgtgtcaatggccatgcagaagtagtaacatttctggtagacagaaagtgccagcttaatgtccttgatggcgaagggaggacacctctgatgaaggctctacaatgcgagagggaggcttgtgcaaatattctcatagatgctggtgctgatctaaattatgtagatgtgtatggcaacacggctctccattatgccgtttatagtgagaatttgttaatggtggcaacactgctgtcctatggtgcagtcatcgaggtgcaaaacaaggctagcctcacaccccttttactggccatacagaaaagaagcaagcaaactgtggaatttttactaacaaaaaatgcaaatgcaaacgcatttaatgagtctaaatgcacagccctcatgcttgccatatgtgaaggctcatcagagatagtcggcatgcttcttcagcaaaatgttgacgtctttgctgaagacatacatggaataactgcagaacgttatgctgctgcttgtggagttaattacattcatcaacaacttttggaacatatacgaaaattacctaaaaatcctcaaaataccaatccagaaggaacatctacaggaacacctgatgaggctgcacccttggcggaaagaacacctgacacggctgaaagcttgctggaaaaaacacctgacgaggctgcacgcttggtggagggaacgtctgccaaaattcaatgtctggggaaagcaacatctggaaagtttgaacagtcaacagaagaaacacctaggaaaattttgaggcctacaaaagaaacatctgagaaattttcatggccagcaaaagaaagatctaggaagatcacatgggaggaaaaagaaacatctgtaaagactgaatgcgtggcaggagtaacacctaataaaactgaagttttggaaaaaggaacatctaatatgattgcatgtcctacaaaagaaacatctacaaaagcaagtacaaatgtggatgtgagttctgtagagcctatattcagtctttttggcacacggactattgaaaattcacagtgtacaaaagttgaggaagactttaatcttgctaccaagattatctctaagagtgctgcacagaattatacgtgtttacctgatgctacatatcaaaaagatatcaaaacaataaatcacaaaatagaagatcagatgttcccatcagaatccaaacgagaggaagatgaagaatattcttgggattctgggagtctctttgagagttctgcaaagactcaagtgtgtatacctgagtctatgtatcagaaagtaatggagataaatagagaagtagaagagcttcctgagaagccatctgccttcaagcctgccgttgaaatgcaaaagactgttccaaataaagcctttgaattgaagaatgaacaaacattgagagcagctcagatgttcccatcagaatccaaacaaaaggacgatgaagaaaattcttgggattctgagagtccctgtgagacggtttcacagaaggatgtgtatttacccaaagctacacatcaaaaagaattcgataccttaagtggaaaattagaagagtctcctgttaaagatggtcttctgaagcctacctgtggaaggaaagtttctcttccaaataaagccttagaattaaaggacagagaaacattcaaagcagagtctcctgataaagatggtcttctgaagcctacctgtggaaggaaagtttctcttccaaataaagccttagaattaaaggacagagaaacactcaaagcagagtctcctgataatgatggtcttctgaagcctacctgtggaaggaaagtttctcttccaaataaagctttagaattgaaggacagagaaacattcaaagcagctcagatgttcccatcagaatccaaacaaaaggatgatgaagaaaattcttgggattttgagagtttccttgagactctcttacagaatgatgtgtgtttacccaaggctacacatcaaaaagaattcgataccttaagtggaaaattagaagagtctcctgataaagatggtcttctgaagcctacctgtggaatgaaaatttctcttccaaataaagccttagaattgaaggacagagaaacattcaaagcagaggatgtgagttctgtagagtccacattcagtctttttggcaaaccgactactgaaaattcacagtctacaaaagttgaggaagactttaatcttactaccaaggagggagcaacaaagacagtaactggacaacaggaacgtgatattggcattattgaacgagctccacaagatcaaacaaataagatgcccacatcagaattaggaagaaaagaagatacaaaatcaacttcagattctgagattatctctgtgagtgatacacagaattatgagtgtttacctgaggctacatatcaaaaagaaataaagacaacaaatggcaaaatagaagagtctcctgaaaagccttctcactttgagcctgccactgaaatgcaaaactctgttccaaataaaggcttagaatggaagaataaacaaacattgagagcagattcaactaccctatcaaaaatcttggatgcacttccttcttgtgaaagaggaagggaacttaaaaaagataactgtgaacaaattacagcaaaaatggaacaaacgaaaaataagttttgtgtactacaaaaggaactgtcagaagcgaaagaaataaaatcacagttagagaaccaaaaagctaaatgggaacaagagctctgcagtgtgagattgactttaaatcaagaagaagagaagagaagaaatgtcgatatattaaaagaaaaaattagacccgaagagcaacttaggaaaaagttagaagtgaaacaacaacttgaacagactctcagaatacaagatatagaattgaaaagtgtaacaagtaatttgaatcaggtttctcacactcatgaaagtgaaaatgatctctttcatgaaaattgcatgttgaaaaaggaaattgccatgctaaaactggaagtagccacactgaaacatcaacaccaggtgaaggaaaataaatactttgaggacattaagattttacaagaaaagaatgctgaacttcaaatgaccctaaaactgaaacagaaaacagtaacaaaaagggcatctcagtatagagagcagcttaaagttctgacggcagagaacacgatgctgacttctaaattgaaggaaaaacaagacaaagaaatactggagacagaaattgaatcacaccatcctagactggcttctgctttacaagaccatgatcaaagtgtcacatcaagaaaaaaccaagaacttgctttccacagtgcaggagatgctcctttgcaaggaataatgaatgttgatgtgagtaatacaatatataacaatgaggtgctccatcaaccactttatgaagctcaaaggaaatccaaaagcccaaaaattaatctcaattatgcaggagatgatctaagagaaaatgcattggtttcagaacatgcacaaagagaccgatgtgaaacacagtgtcaaatgaagaaagctgaacacatgtatcaaaatgaacaagataatgtggacaaacacactgaacagcaggagtctctggagcagaaattatttcaactagaaagcaaaaataggtggcttcgacagcaattagtttatgcacataagaaagttaacaaaagcaaggtaacaattaatattcagtttcctgagatgaaaatgcaacgtcatctaaacgagaaaaatgaggaggtattcaattatggtaaccatttaaaagaacgtatagatcaatatgaaaaagagaaagcagaaagagaagtaagtatcaaaaaatataaatacttttcaaacttcctgaaagaaagtggccttggctaa

SEQ ID NO: 107673 - DNA, 3429 bp, Homo sapiens
  Payload ID: 1132
  Gene Symbol: ANKRD30B
  Gene Name: ankyrin repeat domain 30B
  Uniprot ID: Q9BXX2
  ENST ID: ENST00000580206
  CDS Start-End: 86-1945
ggtaagcgggaagcgagggcgaggggtaggggctggggaagggcgagcgggaggcgcgggctctctctagcagggggctgcagccatgaagaggctcttagctgccgctggcaagggcgtgcggggcccggagcccccgaaccccttcagcgaacgggtctacactgagaaggactacgggaccatctacttcggggatctagggaagatccatacagctgcctcccggggccaagtccagaagctggagaagatgacagtagggaagaagcccgtcaacctgaacaaaagagatatgaagaagaggactgctctacactgggcctgtgtcaatggccatgcagaagtagtaacatttctggtagacagaaagtgccagcttaatgtccttgatggcgaagggaggacacctctgatgaaggctctacaatgcgagagggaggcttgtgcaaatattctcatagatgctggtgctgatctaaattatgtagatgtgtatggcaacacggctctccattatgccgtttatagtgagaatttgttaatggtggcaacactgctgtcctatggtgcagtcatcgaggtgcaaaacaaggctagcctcacaccccttttactggccatacagaaaagaagcaagcaaactgtggaatttttactaacaaaaaatgcaaatgcaaacgcatttaatgagtctaaatgcacagccctcatgcttgccatatgtgaaggctcatcagagatagtcggcatgcttcttcagcaaaatgttgacgtctttgctgaagacatacatggaataactgcagaacgttatgctgctgcttgtggagttaattacattcatcaacaacttttggaacatatacgaaaattacctaaaaatcctcaaaataccaatccagaaggaacatctacaggaacacctgatgaggctgcacccttggcggaaagaacacctgacacggctgaaagcttgctggaaaaaacacctgacgaggctgcacgcttggtggagggaacgtctgccaaaattcaatgtctggggaaagcaacatctggaaagtttgaacagtcaacagaagaaacacctaggaaaattttgaggcctacaaaagaaacatctgagaaattttcatggccagcaaaagaaagatctaggaagatcacatgggaggaaaaagaaacatctgtaaagactgaatgcgtggcaggagtaacacctaataaaactgaagttttggaaaaaggaacatctaatatgattgcatgtcctacaaaagaaacatctacaaaagcaagtacaaatgtggatgtgagttctgtagagcctatattcagtctttttggcacacggactattgaaaattcacagtgtacaaaagttgaggaagactttaatcttgctaccaagattatctctaagagtgctgcacagaattatacgtgtttacctgatgctacatatcaaaaagatatcaaaacaataaatcacaaaatagaagatcagatgttcccatcagaatccaaacgagaggaagatgaagaatattcttgggattctgggagtctctttgagagttctgcaaagactcaagtgtgtatacctgagtctatgtatcagaaagtaatggagataaatagagaagtagaagagcttcctgagaagccatctgccttcaagcctgccgttgaaatgcaaaagactgttccaaataaagcctttgaattgaagaatgaacaaacattgagagcagctcagatgttcccatcagaatccaaacaaaaggacgatgaagaaaattcttgggattctgagagtccctgtgagacggtttcacagaaggatgtgtatttacccaaagctacacatcaaaaagaattcgataccttaagtggaaaattagaagcctacctgtggaaggaaagtttctcttccaaataaagccttagaattaaaggacagagaaacattcaaagcagagtctcctgataaagatggtcttctgaagcctacctgtggaaggaaagtttctcttccaaataaagccttagaattaaaggacagagaaacactcaaagcagagtctcctgataatgatggtcttctgaagcctacctgtggaaggaaagtttctcttccaaataaagctttagaattgaaggacagagaaacattcaaagcagctcagatgttcccatcagaatccaaacaaaaggatgatgaagaaaattcttgggattttgagagtttccttgagactctcttacagaatgatgtgtgtttacccaaggctacacatcaaaaagaattcgataccttaagtggaaaattagaagagtctcctgataaagatggtcttctgaagcctacctgtggaaggaaagtttctcttccaaataaagccttagaattaaaggacagagaaacactcaaagcagagtctcctgataaagatggtcttctgaagcctacctgtgtaaggaaagtttctcttccaaataaagccttagaattaaaggacagagaaacattaaaagcagctcagatgttcccatcagaatccaaacaaaaggatgatgaagaaaattcttgggattttgagagtttccttgaggctctcttacagaatgatgggtgtttacccaaggctacacatcaaaaagaattcgataccttaagtggaaaattagaagatttcaggccgggcactgtggttcacgcctgtaatcccagccctttgggaggcagaggcatgcggatcacgaggtcagcagatcgagaccatcctggctaacatggtgaaaccccgtctctatgaaaaaatacaaaaaattagccaagcatggtggtgggtgcctctagtcccagctactcgggaggctgaggcaggagaatgtgagaacccatgaggcagagattgcagtgagccaagatcatgcacctacactccagcctgggtgacagggccagactctgtgaaaaaaaaaaaaaaaaaagaatttatttattgtggcactattcacaacagcaaagacttggaaccaaaccaaatgtccaacaacgctagactggattaagaaagtatggcacatatacaccatggaacactacgcagccataaaaaatgataagttcatgtcctttgtagggacatgaatgaaactggaaaccatcattctcagcaaactctcgcaaggacaaaaaaccaaacactgcgtgttctcactcataggtgtgaattgaacaatgagaacacatggacacaggaaggggaacatcacactccggggactgttgtggggttggaggagggatagcattaggagatatacctaatgctaaatgacgagttaatgggaacctgcacattgtgcacatgtaccctaaaacttaaagtataatattaaaataaaaaataaagaaaa

SEQ ID NO: 107674 - DNA, 1412 bp, Homo sapiens
  Payload ID: 1133
  Gene Symbol: ANKRD30BL
  Gene Name: ankyrin repeat domain 30B-like
  Uniprot ID: A7E2S9
  ENST ID: ENST00000295181
  CDS Start-End: 251-1006
gcctaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggactgctctatactgggcctgtgccaatggccatgcagaagtagtaacacttctggtagatagaaagtgtcagcttgacgtccttgatggtgaaaacaggaccattctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtgcagacatcgaagtgaagaacaaggctggccacacaccacttttactggccataaggaaaagaagtgaggaaattgtggaatttttactgacaaaaaatgcaaatgcaaatgcagttgataagtttaaatgcacagccctcatgcttgccatatgtcatggatcatcagagatagttggcaagcttcttcagcaaaatgttgacatctgtgctgaagctacatgtggaatgattgcagaacgttatgctgttgcttgtggatttaatctctaagtgtttacatttaaaggctagcgttcatcaacaacttttggaatataaacaaaagatatctaaaaattctcaaaatagtaatccagaaggaacatctgaaggaacacctgatgaggctgcacccttggcggaaagaacacctgacacggctgaaagcttggtggaaagaacacctgatgaataggatacagtgaattcctcttcaaagattttagcctgtaaacatcctttaaaattcaagagggggaagattaagtacaatgagttctgagttcctcatcaaagaacaaatatgtcagtatgttcagcttctctgttctttgttctccgttttaaagtttaacttcctcgttcgttatgcctccttgcccctagtttcattaaacagcccccttctagcctctaa

SEQ ID NO: 107675 - DNA, 1251 bp, Homo sapiens
  Payload ID: 1133
  Gene Symbol: ANKRD30BL
  Gene Name: ankyrin repeat domain 30B-like
  Uniprot ID: A7E2S9
  ENST ID: ENST00000409867
  CDS Start-End: 251-1027
gcctaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggactgctctatactgggcctgtgccaatggccatgcagaagtagtaacacttctggtagatagaaagtgtcagcttgacgtccttgatggtgaaaacaggaccattctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtgcagacatcgaagtgaagaacaaggctggccacacaccacttttactggccataaggaaaagaagtgaggaaattgtggaatttttactgacaaaaaatgcaaatgcaaatgcagttgataagtttaaatgcgttcatcaacaacttttggaatataaacaaaagatatctaaaaattctcaaaatagtaatccagaaggaacatctgaaggaacacctgatgaggctgcacccttggcggaaagaacacctgacacggctgaaagcttggtggaaagaacacctgatgaataggatacagtgaattcctcttcaaagattttagcctgtaaacatcctttaaaattcaagagggggaagattaagtacaatgagttctgagttcctcatcaaagaacaaatatgtcagtatgttcagcttctctgttctttgttctccgttttaaagtttaacttcctcgttcgttatgcctccttgcccctagtttcattaaacagcccccttctagcctctaaca

SEQ ID NO: 107676 - DNA, 6036 bp, Homo sapiens
  Payload ID: 1134
  Gene Symbol: ANKRD31
  Gene Name: ankyrin repeat domain 31
  Uniprot ID: Q8N7Z5
  ENST ID: ENST00000274361
  CDS Start-End: 193-5814
agactgctaccccgccgcgctcgcggccgcctgcgtcctcctcagcagccctgcgacaagtcccggctcctgctgcgattatattatttttatttttaattcacaatttcccctggccctcaaagcgtttttttgtttgcgggcaagagggagttagaggagggtaaaaaagactttgaatgtgaggcaaagatggaggaaggcgtccaggccccagactgggacagtgatgaaactgtgatagagggttcagtgacggagagcgacctggaagaaaaggagctgccctggagaaggttgctgtttgatcaagacgcatctcttaaatctgagttcagtctgcatcctgatacaagaggaatgtgcaaaggcatgccttctcctgagattcaacttggatttaagctcagagaggatctgcaagagcaaatgaataaaaataagatgatgcctgttcttagcgaggatacaatattacagtctcaagatgaaacagaacgaaatcaagctctgttacagactagaaaaaactgttcaatgttcattgggtcgtttcgccagtctggactttcattgaaccaccaaaatattgaagggccagaggctgaaagtcctgaagttttgccacacatagaaaaggaactaagtgaaggcagagattctcctgaagttagccttctctcaggcactgctattacagtatctgatacagttgctgtaaaggagacatcattagtagagccagagaagattttagcagcaccaaatacattttttgagcctagaaaggaagtcacaatgaccatgacttctgaagaaactaaggatgaagaaagctctcttgaaacctttgtgtctgccttagaaagtttacttacatcaccagaaagcacccaggaggaaagattgtttgaattagtaagtgattttgatcgtaaagaattgatgaacccattgagtgactctcttagttccatatcaatacctttgaattcctggtcggcatgtcatagagatttactagaagatgcaaaagatgatgcattgccagctgagttattggaagccctgaacacattgtcagaagccaaggtggaaaccatctgtcacagaaaagagggaggtagcagtctcattgccagaaatgaatgtttagaagtggagttcaatacgtctcagaccaatgaagattgtacacaaatagcagagactctgcaagacccaaatccatctggattgcaaactttggctcatcaaaatatcacttcttgtgagccactaagtaataagagaaattcaaattcagtgacaaatagctctgatcaggaaactgcgtgtgtgttgaggagatcatccagactagaaaaactgaaagtaagcagagatgcaaagtactcagatcacatgtataagatgccagaaaagattttaccaaaaatccttggctgtgaggacctaacaaataataactcttcagctcagaatttcagaatgcaggatccggctttaatgattgatggtaaagagaagaatatgcattcagcaaggttcaagaatggaaaacagatcaggaaaaatgaacaattttcaggaaaaaaagaaaaaatgaaggtgaacaaaatatctcttcatagcattaaccggagaaacatttttggagagaacttagtatataaggctgctctacacgatgatgctgatcttgttcatcattgtataaaaaaaggtggaaatgttaatcagccaagttatgctggttggacagcacttcatgaagctagtgtaggaggattttatcggacagcaagtgaactattaaaaggtggagcagatgtaaatatcaaaggattataccagattactcccctacatgatgcagtgatgaatggacattataaggtggcagagttacttcttctgaatggagctgatccattatttagaaatgatgatggaaaatgtgctttggatgaggccaaggatttatgtatgaagcgtctccttgagagatatatccctaaacatcaaaaatgccttacatcagctcaaaggagtagcattgacccactagacatagaggatgtgtaccaacacaagaaaccaaagttcagttctaaaagtcacatttggcatgtttataatgaaaattccaacagacagaagctggaacatgtaaaagtcaataaaggaagcaaagcgagtttatttataaataaagaagatgtatatgaatattaccaaaaagatcccaaaaacacaaaatttggtaaatccaagcataaacaatcaactcttgaccagatatactctacaggactcagaaagggcaatctccataacgtcaaagatcccaacacaaacgtaccaaaaggtataggaagaagaaaaacacaacataaaaggacccaagtagatgatgtagactgtaatccaagaaagatactagctgtctctccttccaggagaataaacagattggttacctatcagcagcatattccagaaactcataatgaccttccagaagaattgtgtgaaccttccagcttaactctgtcaagcctgagaaatggattagatagcagtactgaggcttgttcagtttccaaagagaaacacatccagaacctggatttatcagatagtcaagaagttcaatgcttggaattagaatctgttgaccaaactgaagctgtttctttcccagggcttttattacataaagaaatcaagttaccagttgttactacagataagcagcctcacactctccaggaacaacaccatgtactttataaatctcatgaaaacagtaacttggtcccaaaagatgagagatttaacaaatgggaaaattctttcctatcctttgtaaaggaaaattctgataatgatgatgatgatgattgctctacctctgagaaggctataacatctaaaaaggtgttgtgttctacaggtggcaaaaaacactataattttaaggagaatttaacaaataaaaaagaaatgggtttccaacagtttttactttctgaagatcatctttcacaggaaaatgagttaaaagcagtcagcctaaccacacttccagaacaggaagctgttaatttttcttattcagataatgcagttatttctgaacatgttgcaaattatgaacaatgcatatttggaccttcttttgatcactcaaatggcaatcctgagcaaaattccctggcttgtatgagaacacttttgacacatgaggcttcaaagttgactaatcatgtggagctattcaaaaagccacaggattatattcccagagcaccaacttttttaatgaatcaaacagatacacatattgtggaaaagatggcaaagaattgtgacactgagaggaattacattgacagagaccaaaaaataatttattcaaatgagcctttatccatagttgctcattctcaagtaatagaaacaactaaagttgaaaaaaggagacaaaaccatctagaaagtgagactatacacaatatagattctcattccactgacaatatgagtaaagaattggccaacatctcaaaacttagtcaaagagaaaagaaggaaatttctcacaaaccaggaatgaaagcaggtaggatcaacaagaggaatgccagaggggaaagccagcttcatttagctgtcagaagaggaaatctgcccctagtgaaagccctgatagaatctggagcagatgtgaatctaaatgataatgcaggttggacaccacttcatgaggcatctaatgaaggatctattgatataattgtagagttattaaaagctggtgctaaggttaattgtgaaaatatagatggaattctgcccttacatgatgctgttgcaaacaatcatttaaaggcagctgagattctactacaaaatggagcaaaccctaatcaaaaagatcaaaaacagaagagtgctttggatgaagcagatgatgaaaaaatgaaagaattactaagatcttatggtgctattgagactgttaatagagatgagagtgatgctatagtcaatgaaaaaattcctgctgtccggtctaaaagacataaacagtgtttttgtgatgatggcaaaactattgactcatcttccctttcacaccaagaaagatcaagagaaagcctttctgtgcatcagaccctcagtgccattctacaagatatagaagaaaaacaagaatatttattagagtttgaaataagaaaccctgaagatgcagaacaatacattgaaaagatgttaaagataaaaaagattatggataatgtgcttgccaagcagaaagcagaaagggatgatctggctaaaaaatacagggtatccatagagtcatttaagcatggagccctgagagaacaattggccaacttggctgcaagacagaagagccttttagttgtggcaaaaaaacagaaaaaaataagcctgaaaattcaaaactgtaggaatgttacatcattgccttgtcttagtttaaggaagctcccacccagatcagaaatctctagtgaaaaagacagccaagagctcactagtctggaaaatttagagcatccccaatcaggttcactttctcctgtttctggaagcatgcaggaaacacaattgtctctggaaacttggaactacagccaaaataccaacatttgtctaaattcagaggcagtgagaaggggagaattttctggaaatgatatgaattctaaacaaaatggcagtgattgtaccttggatggttttccaaaatccagacattcagatggcacagagaagaataaattaccatcccaacctgttgcttttattggtcaaacagaatattcacagaaagagaatgatcttacagaagctacagacaaagaccatgaattctatgtttcttccccagtaatcggcaaattaaatatttcagaaactgcaagtgtccttgccgaaaatgctgcccatccatcaaatattatttgtgatcaggacctttccaattatgatcccaaaagaggaaacagaaaaacaagttcccagcaatcacctacaggggcatcagaatctctggcacatcaagggattgctgtcttaggcagtgatacagtgcatcagatgaaaccatatcttaaaaaatcagtttctgttgttccatgtgcagatgacagtcagatctcctcttcctctggatctgggcaacaagatacaataaaaaaggctttaaactacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaaccaaacaaatcaatgtttgagaaaacaaaatttggacaaggaacttccagagagtcaatgcaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattaccaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactagaccata

SEQ ID NO: 107677 - DNA, 6207 bp, Homo sapiens
  Payload ID: 1134
  Gene Symbol: ANKRD31
  Gene Name: ankyrin repeat domain 31
  ENST ID: ENST00000506364
  CDS Start-End: 193-5985
agactgctaccccgccgcgctcgcggccgcctgcgtcctcctcagcagccctgcgacaagtcccggctcctgctgcgattatattatttttatttttaattcacaatttcccctggccctcaaagcgtttttttgtttgcgggcaagagggagttagaggagggtaaaaaagactttgaatgtgaggcaaagatggaggaaggcgtccaggccccagactgggacagtgatgaaactgtgatagagggttcagtgacggagagcgacctggaagaaaaggagctgccctggagaaggttgctgtttgatcaagacgcatctcttaaatctgagttcagtctgcatcctgatacaagaggaatgtgcaaaggcatgccttctcctgagattcaacttggatttaagctcagagaggatctgcaagagcaaatgaataaaaataagatgatgcctgttcttagcgaggatacaatattacagtctcaagatgaaacagaacgaaatcaagctctgttacagactagaaaaaactgttcaatgttcattgggtcgtttcgccagtctggactttcattgaaccaccaaaatattgaagggccagaggctgaaagtcctgaagttttgccacacatagaaaaggaactaagtgaaggcagagattctcctgaagttagccttctctcaggcactgctattacagtatctgatacagttgctgtaaaggagacatcattagtagagccagagaagattttagcagcaccaaatacattttttgagcctagaaaggaagtcacaatgaccatgacttctgaagaaactaaggatgaagaaagctctcttgaaacctttgtgtctgccttagaaagtttacttacatcaccagaaagcacccaggaggaaagattgtttgaattagtaagtgattttgatcgtaaagaattgatgaacccattgagtgactctcttagttccatatcaatacctttgaattcctggtcggcatgtcatagagatttactagaagatgcaaaagatgatgcattgccagctgagttattggaagccctgaacacattgtcagaagccaaggtggaaaccatctgtcacagaaaagagggaggtagcagtctcattgccagaaatgaatgtttagaagtggagttcaatacgtctcagaccaatgaagattgtacacaaatagcagagactctgcaagacccaaatccatctggattgcaaactttggctcatcaaaatatcacttcttgtgagccactaagtaataagagaaattcaaattcagtgacaaatagctctgatcaggaaactgcgtgtgtgttgaggagatcatccagactagaaaaactgaaagtaagcagagatgcaaagtactcagatcacatgtataagatgccagaaaagattttaccaaaaatccttggctgtgaggacctaacaaataataactcttcagctcagaatttcagaatgcaggatccggctttaatgattgatggtaaagagaagaatatgcattcagcaaggttcaagaatggaaaacagatcaggaaaaatgaacaattttcaggaaaaaaagaaaaaatgaaggtgaacaaaatatctcttcatagcattaaccggagaaacatttttggagagaacttagtatataaggctgctctacacgatgatgctgatcttgttcatcattgtataaaaaaaggtggaaatgttaatcagccaagttatgctggttggacagcacttcatgaagctagtgtaggaggattttatcggacagcaagtgaactattaaaaggtggagcagatgtaaatatcaaaggattataccagattactcccctacatgatgcagtgatgaatggacattataaggtggcagagttacttcttctgaatggagctgatccattatttagaaatgatgatggaaaatgtgctttggatgaggccaaggatttatgtatgaagcgtctccttgagagatatatccctaaacatcaaaaatgccttacatcagctcaaaggagtagcattgacccactagacatagaggatgtgtaccaacacaagaaaccaaagttcagttctaaaagtcacatttggcatgtttataatgaaaattccaacagacagaagctggaacatgtaaaagtcaataaaggaagcaaagcgagtttatttataaataaagaagatgtatatgaatattaccaaaaagatcccaaaaacacaaaatttggtaaatccaagcataaacaatcaactcttgaccagatatactctacaggactcagaaagggcaatctccataacgtcaaagatcccaacacaaacgtaccaaaaggtataggaagaagaaaaacacaacataaaaggacccaagtagatgatgtagactgtaatccaagaaagatactagctgtctctccttccaggagaataaacagattggttacctatcagcagcatattccagaaactcataatgaccttccagaagaattgtgtgaaccttccagcttaactctgtcaagcctgagaaatggattagatagcagtactgaggcttgttcagtttccaaagagaaacacatccagaacctggatttatcagatagtcaagaagttcaatgcttggaattagaatctgttgaccaaactgaagctgtttctttcccagggcttttattacataaagaaatcaagttaccagttgttactacagataagcagcctcacactctccaggaacaacaccatgtactttataaatctcatgaaaacagtaacttggtcccaaaagatgagagatttaacaaatgggaaaattctttcctatcctttgtaaaggaaaattctgataatgatgatgatgatgattgctctacctctgagaaggctataacatctaaaaaggtgttgtgttctacaggtggcaaaaaacactataattttaaggagaatttaacaaataaaaaagaaatgggtttccaacagtttttactttctgaagatcatctttcacaggaaaatgagttaaaagcagtcagcctaaccacacttccagaacaggaagctgttaatttttcttattcagataatgcagttatttctgaacatgttgcaaattatgaacaatgcatatttggaccttcttttgatcactcaaatggcaatcctgagcaaaattccctggcttgtatgagaacacttttgacacatgaggcttcaaagttgactaatcatgtggagctattcaaaaagccacaggattatattcccagagcaccaacttttttaatgaatcaaacagatacacatattgtggaaaagatggcaaagaattgtgacactgagaggaattacattgacagagaccaaaaaataatttattcaaatgagcctttatccatagttgctcattctcaagtaatagaaacaactaaagttgaaaaaaggagacaaaaccatctagaaagtgagactatacacaatatagattctcattccactgacaatatgagtaaagaattggccaacatctcaaaacttagtcaaagagaaaagaaggaaatttctcacaaaccagatgaggaattaactaataacatcagtggagatgaaataactataagaaattgtgaggagataaaagaaaaaacggagtcagaaattcacatgcctactaatagccaagaacacaaaacagttcagaatttcagaaaaagacaaagtttcttaaaaactacctgcaacctaggaatgaaagcaggtaggatcaacaagaggaatgccagaggggaaagccagcttcatttagctgtcagaagaggaaatctgcccctagtgaaagccctgatagaatctggagcagatgtgaatctaaatgataatgcaggttggacaccacttcatgaggcatctaatgaaggatctattgatataattgtagagttattaaaagctggtgctaaggttaattgtgaaaatatagatggaattctgcccttacatgatgctgttgcaaacaatcatttaaaggcagctgagattctactacaaaatggagcaaaccctaatcaaaaagatcaaaaacagaagagtgctttggatgaagcagatgatgaaaaaatgaaagaattactaagatcttatggtgctattgagactgttaatagagatgagagtgatgctatagtcaatgaaaaaattcctgctgtccggtctaaaagacataaacagtgtttttgtgatgatggcaaaactattgactcatcttccctttcacaccaagaaagatcaagagaaagcctttctgtgcatcagaccctcagtgccattctacaagatatagaagaaaaacaagaatatttattagagtttgaaataagaaaccctgaagatgcagaacaatacattgaaaagatgttaaagataaaaaagattatggataatgtgcttgccaagcagaaagcagaaagggatgatctggctaaaaaatacagggtatccatagagtcatttaagcatggagccctgagagaacaattggccaacttggctgcaagacagaagagccttttagttgtggcaaaaaaacagaaaaaaataagcctgaaaattcaaaactgtaggaatgttacatcattgccttgtcttagtttaaggaagctcccacccagatcagaaatctctagtgaaaaagacagccaagagctcactagtctggaaaatttagagcatccccaatcaggttcactttctcctgtttctggaagcatgcaggaaacacaattgtctctggaaacttggaactacagccaaaataccaacatttgtctaaattcagaggcagtgagaaggggagaattttctggaaatgatatgaattctaaacaaaatggcagtgattgtaccttggatggttttccaaaatccagacattcagatggcacagagaagaataaattaccatcccaacctgttgcttttattggtcaaacagaatattcacagaaagagaatgatcttacagaagctacagacaaagaccatgaattctatgtttcttccccagtaatcggcaaattaaatatttcagaaactgcaagtgtccttgccgaaaatgctgcccatccatcaaatattatttgtgatcaggacctttccaattatgatcccaaaagaggaaacagaaaaacaagttcccagcaatcacctacaggggcatcagaatctctggcacatcaagggattgctgtcttaggcagtgatacagtgcatcagatgaaaccatatcttaaaaaatcagtttctgttgttccatgtgcagatgacagtcagatctcctcttcctctggatctgggcaacaagatacaataaaaaaggctttaaactacagtacagctcctaaaaagaaatgtattcagataaaagatttgatattactaggaagaattaacccaggaaataacattctggaattcaaaacacaggagactacccacaaagccagtattttattgaatggtaaacttaaggtagaaagtggtcagatttataaaaacccagtcacctggctcaaggatcttctgggaggcaacagttatgtgacctggaattatgcttggagtaaggtaacgtatcttgggaaggagcttttaaggtatgtttctgaggatgcacccatacttccagaaccaaactcagtacctcagcaatatcaaccttgtcttccagaagttgcttgtttagatgacccagtacaggaaccaaacaaatcaatgtttgagaaaacaaaatttggacaaggaacttccagagagtcaatgcaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattaccaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactagaccata

SEQ ID NO: 107678 - DNA, 1935 bp, Homo sapiens
  Payload ID: 1135
  Gene Symbol: ANKRD33
  Gene Name: ankyrin repeat domain 33
  Uniprot ID: Q7Z3H0
  ENST ID: ENST00000301190
  CDS Start-End: 228-1586
atctccgccggcgtccccaaggctgagagtgggcgcgtccgtcaggaggagtcgtctttgtgagcccgccccggcggggaggagctgcccggctcaggccccgcccacccggaggatcttggggctggtctgagtccgctcctgagacgtgaccacccgccccgcatggggccccagtcccagctgcttgatccggctcagccccgaggtgtttgcagcagctctttatgaaagtccagccatctgttacctgcgttgcttcctggggagggatagtccacctggaggcattcggagacccagtgattgtgctccgcggagcctgggctgtgccccgcgttgactgcctcatagataccctacgaaccccaaatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggaggacaggcctcatggtcgcatgctaccacggcttccagagtgttgtggccctgctcagccactgtcctttccttgatgtgaaccagcaggacaaaggaggggacacggccctcatgttggctgcccaagcaggccacgtgcctctagtgagtctcctgctcaactactatgtgggcctggacctggaacgccgggaccagcgggggctcacggcgttaatgaaggctgccatgcggaaccgctgtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttaggtactgccccgccccctcccctggttccccagtccccgccagggagtccccagaggtccccgtgggtcttcgtcccctaccagagccctcagggcatattgagcaagtgccttcagtggctacaacccagggatagcaccagccccaggccccaagtccccaagatcctcctctccaaggcatcctcatcctcccaccagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggagtgcctccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtg

SEQ ID NO: 107679 - DNA, 1507 bp, Homo sapiens
  Payload ID: 1135
  Gene Symbol: ANKRD33
  Gene Name: ankyrin repeat domain 33
  Uniprot ID: Q7Z3H0
  ENST ID: ENST00000340970
  CDS Start-End: 372-1190
gcttcctggggagggatagtccacctggaggcattcggagacccagtgattgtgctccgcggagcctgggctgtgccccgcgttgactgcctcatagataccctacgaaccccaaatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggagggcctcatggtcgcatgctaccacggcttccagagtgttgtggccctgctcagccactgtcctttccttgatgtgaaccagcaggacaaaggaggggacacggccctcatgttggctgcccaagcaggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctcccagggcttctttcccctctggagtgcctccggcctccccatccacctctgcctaagtaaatctgctctcaacctatatatatacaaggtcattcattctagcattgtttgcaagagtgaaagagtggaaacacccgaagtgtccatcagtaagggacaggctagattgattacggatgtaattgctgtccatccatacagagcatactctacagtgtattctaaaataagactaaggaagctgtttatattctgatatgaaactaccatcaagatgtataaagtaaaaataactaaggagtggaa

SEQ ID NO: 107680 - DNA, 1286 bp, Homo sapiens
  Payload ID: 1135
  Gene Symbol: ANKRD33
  Gene Name: ankyrin repeat domain 33
  ENST ID: ENST00000549751
  CDS Start-End: 179-589
agtcgtctttgtgagcccgccccggcggggaggagctgcccggctcaggccccgcccacccggaggatcttggggctggtctgagtccgctcctgagacgtgaccacccgccccgcatggggccccagtcccagctgcttgatccggctcagccccgaggtgtttgcagcagctctttatgaaagtccagccatctgttacctgcgttgcttcctggggagggatagtccacctggaggcattcggagacccagtgattgtgctccgcggagcctgggctgtgccccgcgttgactgcctcatagataccctacgaaccccaaatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacagcaatgggagggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgctgacctgacagcagtggaccctgttcggggcaagacggccctggaatgggcagtgctgaccgacagcttcgacaccgtgtggaggattcggcagctgctgaggcggccccaagtggagcagcttagccagcactacaagcccgagtggccggccttgtccgggctcgtggcccaggcccaggcccaggcccaggttgccccttcactcctagaacggctgcaggctaccttgagcctcccctttgccccgtctcctcaggaggggggtgttctggaccaccttgtgactgccacaaccagcctggccagtcccttcgtcaccactgcctgccacactctgtgccctgaccatccaccttcgctgggcacccgaagcaagtccgtgccagagctgttagtgccagccgaagcccagtccttcaggacaccaaagtctggcccttcctctctggcgataccaggagctcaggatagagaagaggaaacaggaggaggaggccagaatggcacagaagtaggggaagatgggataggacaggctgggaacaggtaatcaggcccctccca

SEQ ID NO: 107681 - DNA, 9188 bp, Homo sapiens
  Payload ID: 1136
  Gene Symbol: ANKRD33B
  Gene Name: ankyrin repeat domain 33B
  Uniprot ID: A6NCL7
  ENST ID: ENST00000296657
  CDS Start-End: 1-1485
atggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcaggaccggccttattgtcgcctgctaccacggctttgtggataccgtggtggccttagcagagtgcccccacgttgacgtcaactggcaggacagcgaggggaacacagccctaatcacagctgcacaggcagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 107682 - DNA, 1591 bp, Homo sapiens
  Payload ID: 1136
  Gene Symbol: ANKRD33B
  Gene Name: ankyrin repeat domain 33B
  ENST ID: ENST00000504806
  CDS Start-End: 139-735
ggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcaggaccggccttattgtcgcctgctaccacggctttgtggataccgtggtggccttagcagagtgcccccacgttgacgtcaactggcaggacagcgaggggaacacagccctaatcacagctgcacaggcaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccct

SEQ ID NO: 107683 - DNA, 3613 bp, Homo sapiens
  Payload ID: 1137
  Gene Symbol: ANKRD34A
  Gene Name: ankyrin repeat domain 34A
  Uniprot ID: Q69YU3
  ENST ID: ENST00000606888
  CDS Start-End: 1296-2786
agcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgcccccccccccccccccccccccgccaagcttctctcctcccgagccggcgctgtgcccggggcgctccgggaggagggaccaggatccggcgccggggcgcagatactgacaccaagggaatccgggtgcccccccccccacgccatgcgggcccccaggaaactggctccgccacctcggctgccccgtggccacggccccaatcctggccaggcggagattctgcggacattcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagt

SEQ ID NO: 107684 - DNA, 716 bp, Homo sapiens
  Payload ID: 1137
  Gene Symbol: ANKRD34A
  Gene Name: ankyrin repeat domain 34A
  ENST ID: ENST00000619813
  CDS Start-End: 361-716
gcgctccgggaggagggaccaggatccggcgccggggcgcagatactgacaccaagggaatccgggtgcccccccccccacgccatgcgggcccccaggaaactggctccgccacctcggctgccccgtggccacggccccaatcctggccaggcggagattctgcggacattcaggtctcaaatgcaggctgcttccctccccccactcaatttttggggttgtggcaagctaaaacagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccct

SEQ ID NO: 107685 - DNA, 571 bp, Homo sapiens
  Payload ID: 1137
  Gene Symbol: ANKRD34A
  Gene Name: ankyrin repeat domain 34A
  ENST ID: ENST00000619519
  CDS Start-End: 261-571
gtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagaccc

SEQ ID NO: 107686 - DNA, 3938 bp, Homo sapiens
  Payload ID: 1138
  Gene Symbol: ANKRD34B
  Gene Name: ankyrin repeat domain 34B
  Uniprot ID: A5PLL1
  ENST ID: ENST00000338682
  CDS Start-End: 674-2218
agctgctggcccccctgggtccagaggagccttgccgccctcacctgcgcagagcctggagccgacgcgtcacccccagcggaagcgcctcgctgcccgggcgtctggcgaggtgtgcgctccgggtcccagctccagcgcttcgcggcagtcgcccgcctctttccgcaagcagggcggggactgggcggcatctaccgagatctgcgattcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagttgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagagtcccccattattaatgcaccagaacagagtggcttcattgcaagaggagctccaggatattacaccagaggaagaactatcctataaaaccaatgggctggcactttccaagcggttcatcactaggcaccaaagcattgatgtaaaagacactgcacatttgctaagagcctttgatcaggccagctcaaggaagatgtcatatgatgaaataaattgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaaaggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacaaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacaccgacagctgtaaaatgttctaagataaaaaaactcgagctacaaagaaagaatgaactaattctttacaaatgttgactgaagatagataaaactctaattaaaaatttaaaaggttaaacactgtattagaatgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaaagaaccaaaaaaaaaaaattcatcatggataaaaactaagcgcttgccttcttttaaaaagaaaaactgatgattagattaggttagctaaaattaatagaggcagtagaaacttaatcacaaaatgtactaaatatttggcaatattaaacaatgcctttttatttctgatatgtagttattagacatttatatattaaggataacttccttagtgtgacattccaatcatttagtattttaggacctgtgaataacttccaacaaaattaatgaataccatattagtattataaaatattataaagtaataattatatcatctatataacttcaaagtatgatgtttatacaaagaatccttatttcagtctagcagcttaacaacaaaggataaatcagactatacaaaacctaagtgtattaatttgatgattgtcacgtacaactttctttgccttccaagtagaggtgatcctaacaattggcatgatgcttttcttggtaatttgatataagcaagttgtaatgtacatagtaattatttaattactgtggcttttattttaaaaagtaattagaggtttttccatttcatgtcttgaacaacattaatattaattacactagaaatattttttgattcagaacttagaattgtacctgatatttataggtatttaaatgctttctgcaagttaaatatcgagaaaagtacttgacttcaagttgtaaggatacaatttggaagggtatgtaaatagattagttcataaacaaaatggtatcaataaagattttaaatatca

SEQ ID NO: 107687 - DNA, 542 bp, Homo sapiens
  Payload ID: 1138
  Gene Symbol: ANKRD34B
  Gene Name: ankyrin repeat domain 34B
  ENST ID: ENST00000508916
  CDS Start-End: 492-542
agctcagctcagacggcgccctagggccgcacagagggtcgggcagtgccggagagaggtttgaaagcgccgccgccaactcgacagcgcgtcccaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcaggcacggccgtcgccagcatagtaccggctcctcttcttctcccagaacctcctgacaccaaccttggtgaaagaaaagctgtgacaatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagca

SEQ ID NO: 107688 - DNA, 4951 bp, Homo sapiens
  Payload ID: 1139
  Gene Symbol: ANKRD34C
  Gene Name: ankyrin repeat domain 34C
  Uniprot ID: P0C6C1
  ENST ID: ENST00000421388
  CDS Start-End: 1-1608
atgatggatgatgacactgaattaaggactgatggaaactctttgttaaaggctgtgtggctggggaggctcaggttgaccaggctgctcttggaagggggagcttatatcaatgaaagcaatgacaaaggcgaaacagctctcatggtggcgtgcatcaccaaacatgtggaccagcaaagcatcagcaagtccaagatggtgaagtacctgctggacaacagggcagaccccaatatccaagataagtctggcaagactgccctcatccatgcctgtatcagaagagctgggggagaagtggtctccttattactggagaatggagcagaccccagccttgaagatcgcactggggcttcagctctggtttatgcaataaatgcagatgacaaggatgcattgaagcatctccttgatgcctgcaaagccaaagggaaggaggtgattattataacaacagataaatcgtcttcaggcaccaaaaccaccaaacagtatcttaatgtccctccttcacccaaagtagaagacaggcattcacctccactgtgtgcgtctccctctgacatagagctgaaggctctaggcctggactctccactcactgagaaggaagatgacttcttcagcctccaagcagggcatccaagcagttgtaacacctccaaggctgttaatgagcctgggtcacccaccaggaaagtcagtaatctcaaaagggcccgtttgcctcaactgaagaggctccagtctgaaccttggggcctgatagcgccctcggtgctggcagcctcgacgcgtcaggatgagacccatggtgccagcacagacaacgaggtcatcaagagcatcagtgatatatccttccctaaaagggggcccctctccagaaccaacagtatcgatagcaaagaccccaccctctttcacacagtcacagagcaggttctgaagattccagtctcttcagcaccggcatcctggaaagcagcctatgagaaaggtcaggctccccacccacgtctggccaggagaggaactctccctgttgaccaagagaaatgtggtatgggtccatcaggaccctctgctctcaaagagcctgcatccctcaaatggctggaaaatgacctctatgacttagatatacagccagggcctgaccctcccaactccatttcccttgaatccggcaaaggacctttagatagaaagaagctcaacagctctcacttgtctcttttccatggctctcgggagtccctggacactgtacctagcacatcccccagctcagcacgccgcaggccgccacatcttctagaacgacgaggttctggaactctgctccttgatcgcatttctcacactaggcctggcttcctgccgcctttaaatgtgaatctgaacccgcctattccagatattagatctagcagcaaaccttcttgctctcttgctagtggcttaaaatctatggttcctgttgctccaagttcaccaaagagagttgacttaagaagtaaaaagaagctcctcagaaggcattctatgcaaattgaacaaatgaaacagctgtctgattttgaagaaatcatgacctagaagctttagaaaggcttaaaatagtcaatatagtttatggaagggactatggatgagactgcttcctgatcattccttaatgttgaactgtggccacttcagaagatataaaagcaggatgctgcttcacttctgagaataatccctgggtttttataggcctacttgaaaagagctcaggataattgggttttgaagataaatttttaaaaattctgcaaaggaagaaagcctttggaatttgaaggtaacacagcaagtacaatgatgtaagctggggacatcagtagttttctatcagacaaacagaaaagaatttaaatcaggaggtagtatttggagtatgtcatttgtaataaatctataaagtgcctacatagaaaacgaggctttaacatttgttagaatgtacaaaagccccaaaccaaaccctcagtgactaaatctgggtgtctgggttctatctgatggagtagaagcagaattccccccatggaagaggctctggcctgtgggtcctggctctgactctgtcagggcactgtaaatcatggtgtggttgaactcgttcagtaatccagtaatatattttgttcacatactaatttgtatgtgctctgagtacccaaatatcccatctatgtggcccctgaattatgatatgtcatagtagctgatgccttagagataaatcttgctccagaaatgaaactttccccagacccgtcccctgacacaggctcttgtattgaaatcttgtgaaaaacagtcaaggttaactaacttggagttgaatgtgatacaattatagattaaaaatatcagaagcatttccagattattcttaaaagttgatgagatcttcccaaaccagaatgacaactgaggatgagatgtgcatagattaaatggtaaagtgggtggttctcaggtgagaagcagtgaggaccattcattttgcagcctaaaaattttaggggatgcaaactgtcatttccccttcagttatgtaaataattgaagaaaaatctggtttcttctcttcctgatctatctaggtgagaagagatttgtagaaataacctgcacaacccttttaggctgctttgagcaaatccaagaaggaaagcagagacttagcacatttggtataatgtagccacatcttagatgaatatatttttggttatttccatttatgtttcctctcgtgctgctgagatctatttgctctatggttaaaaagttcaatagttcctgaggacagcatcatatagaggaaagagggctttgagtctgacatatttgggtttgcataccagtcttatcatttaccagctgcgtgaccttgaggaggcagcttaacttctcttagtctctgttccctcatctgtaaaataggattagtagtgctgcaccttacaaggttgtgatgagaattaaatgacacaatgtatgaaagtgctgccattgtgcctggcacaggtagaagtcactggataagaagtagctaattttaatgtatttcttgagactgctgaagcaatatctcaaataatacatacgctacacaaaatggaataaagtttctctggaaaagttcaagtatctctatgagatccccagttatttttataagtaccgatctctaaactcatgtgtaaagtaaaaaattctgccatataaactctacatattatataatttttctataactacctttgctagaaatttatctgaatattccaaacaaaagtgttaatgatggttaaacaaaaaaactcggtgttgtttggagggctgtctgtcctgtgtgttgtaggatgtttagcagcatctctggcctccactcactagatggcagtaacaccctctccccagttgtgacaaccaaaaatgtctctagacgtggccagatgtctcctgggtgcatcaccttcgttgatctctactgctagacctatcgtatatgtcaagaacaacaaagctgtatggaaatgtgagtgctgactggacagctatgccctcctgttaacttaagacaattcaaattgtgctttagtaagaggactaatcaatactagtgttgggccttcaggattcttggcaaacacactccaacatgtgtgctaatggtctcatactttgtaggaagggaagaaaataaggaaagcacataaactagcaaaaatctatagctcatgaacttggtttagtgtggacaaccctgttcttttcagaactatttaatcattaatagttcttaccaagtagaagtgatcccaggcaaagaaacaactttccaatgcattcaagagagaatcatacggacaaccatcattctcagcagctcattaaatgcaaatacacacacgcaaagagagagagagaacacattttacatagttttccagctgttgttagtgtcacttaaaactgatctctgctggtagtattcagttgtgagtatagcaagacactgcataggagcattttttttctaaacctttagctaagatttggaaacccaatatttcctaagtagtgaatgtggtctatttatagtaattagcttaggtgacacaccaaacatgatgagttgctcattcaggatagccggtccattgcacaaatgtgtaatatcaggtactctcatgccactcattgcctgcatcagtcagtcatgacctttgcatcagcctttcaatagacagtcatcaggctagtatcttatctcatcactacttgacgatgagttcgccgaattagactgttctataccagtacaacaaccaaaatactttctcatagattatgcataaatacgcaattttgtccatgtcaatgaacctaacaagaatgctttttaaaagtatattttagattcaaacatgctttctagatcagaggttaacttgtctttttgaaatcctggagtcacttataagttagctgcaaactgtagtttcggtaattcaactgcttaagcatttctggactgtttatcaaaatatattacagaatgtgagactaaagtttaaagtctggacctttggtttaatttctagactttccaaagcttttttttttctttttaaaaagcccattgtcaactctcttagaacttcatcaagtaaatggtaccttgcaaatgtaggttgtgtctgaccttctttctttttgtgtgttggtgcctcagatgtatcatgtgctgcttgaactgattctctacagtgttccttcctagtctcaagctgatgatgtgctcaaagatgtatcaaaatccatgtaatgacaccttttagatgtttctaatatgtcaataaatgatatattgcaatcc

SEQ ID NO: 107689 - DNA, 3342 bp, Homo sapiens
  Payload ID: 1140
  Gene Symbol: ANKRD35
  Gene Name: ankyrin repeat domain 35
  Uniprot ID: Q8N283
  ENST ID: ENST00000355594
  CDS Start-End: 88-3093
gcacagccgcagccaagtccggtgggttcgggaacctgtggcccggctctctgcgcgtccccatcccccgtggccccgaccccggccatgaagcgtatcttctcctgctccagcacacaggtggcggtggagagatggaaccgccatgatcagaagctgctggaggcagtgcacaggggggatgtgggacgcgtggctgccctggcctccaggaaatctgcccgacccaccaagcttgactcgaatggccagtccccgtttcatctggcagcctccaaaggcctgacagaatgtctgactatcctgcttgcaaatggggctgacatcaacagcaagaatgaggatggaagcactgccctacacttggccaccatctcctgccagccacagtgtgttaaggttctgcttcagcatggtgctaatgaagatgctgtggatgcagaaaaccgtagtccattgcactgggcagcctcctctggctgtgcctcaagtgtgctcctgctgtgtgaccacgaagccttcctggacgtgttggataatgatggacgtacacccctgatgatcgcatcgctgggtgggcacgcagctatctgctcacagctgctgcagcgaggcgcccgagttaatgttacagacaagaatgacaaatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtcagaggctagtccagcacccagatctcgcatcccaggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcaaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccacaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggg

SEQ ID NO: 107690 - DNA, 3093 bp, Homo sapiens
  Payload ID: 1140
  Gene Symbol: ANKRD35
  Gene Name: ankyrin repeat domain 35
  ENST ID: ENST00000544626
  CDS Start-End: 109-2844
gctttttgacagctgtctcttgcacagccgcagccaagtccggtgggttcgggaacctgtggcccggctctctgcgcgtccccatcccccgtggccccgaccccggccatgaagcgtatcttctcctgctccagcacacagtgtgttaaggttctgcttcagcatggtgctaatgaagatgctgtggatgcagaaaaccgtagtccattgcactgggcagcctcctctggctgtgcctcaagtgtgctcctgctgtgtgaccacgaagccttcctggacgtgttggataatgatggacgtacacccctgatgatcgcatcgctgggtgggcacgcagctatctgctcacagctgctgcagcgaggcgcccgagttaatgttacagacaagaatgacaaatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtcagaggctagtccagcacccagatctcgcatcccaggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcaaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccacaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggg

SEQ ID NO: 107691 - DNA, 6269 bp, Homo sapiens
  Payload ID: 1141
  Gene Symbol: ANKRD36
  Gene Name: ankyrin repeat domain 36
  Uniprot ID: A6QL64
  ENST ID: ENST00000420699
  CDS Start-End: 245-6070
gggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagtgtgaatatcagccactgttatttgctgtgagtcgaagaaaagtgaaaatggtggaatttttattaaagaaaaaagcaaatgtaaatgccattgattatcttggcagatcagccctcatacatgctgttactcttggagaaaaagatatagtcattcttcttctgcagcacaatattgatgtgctttctcgagatgcgtttcgaaagattgcaggagattatgccattgaggctaagaatagagtcatttttgatctaatttatgaatacgaaagaaagagatatgaagatcttcctataaatagcaatccagtgtcttctcagaaacaaccagccttgaaggctacaagtggcaaggaagattctatttcaaatatagccacagaaataaaggatggacaaaaatctgggacagtgtcttctcagaaacaaccggccttgaaggatacaagtgacaaggatgattctgtttcgaacacagccacagaaataaaagatgaacaaaaatctgggacagtgcttcctgctgttgaacagtgtttaaacaggagtctctacagacctgatgctgttgcacagcctgtgacagagaatgagttttctttggaatctgagattatttcaaaactatacatcccaaagagaaagattatttctccacgatctataaaagatgtgcttcctcctgttgaagaggctgttgacaggtgtctctacctactggaccgttttgcacagcctgtgacaaaggataagtttgctttggaatctgagaatatttcagaaccatactttacgaacagaaggactatttctcaacaatctgcagaaaatttagatgctgcatgtggcattgacaaaacagaaaatggaaacatgtttgaagaccaaaatgttgataaggaaggaaaagcactaccagcaactggacaaaaagcaaatgtgtctcctgagcaaccgcctttattcacgcatacggtgaaagacagagatcacatttcaactagattcttaggaggtatggattcactaacttccagtgaagaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgacgagaaagattctgtttcaaatatagccacagaaataaagaagggacaacaatctgggacagtgtctcctcagaaacaatcggcctggaaggttatatttaaaaagaaagtttctcttttgaatattgccacaagaataatgggtggtgggaaatctggaacagtgtcttctcagaaacaaccagcctcaaaggctacaagtgacaagacagattctgctttgaatatagctacagaaataaaggatggactacagtgtgggacagtgtcttctcagaaacaaccagccttgaaggctacaactgacgaggaagactctgtttcgaatatagccacagaaataaaggatggagaaaaatctgggacagtgtcttctcagaagcaaccagccttgaaggctacaactgacgaggaagattctgtttcgaatatagccacagaaataaaggatggagaaaaatctgggacagtgtcttctcagaaacaaccagccttgaaggctacaactgatgagaaagattctgtttcgaacatagccacagaaataaaggatggagaaaaatctgggacagtgtcttctcagaaaccaccagccttgacggctacaagtgacgaggaaggttctgttttgagtatagccagagaaaacaaggatggagaaaaatctaggacagtgtcttctcggaaaaaaccagccttgaaggctacaagtgatgagaaggattctttttcgaatataaccagaggaaaaaaggatggagaaatatctaggaaagtgtcttctcagaaaccaccaaccttgaagggtacaagtgacgaggaagattctgttttgggtatagccagagaaaacaaggatggagaaaaatctaggacagtgtcttctgagaaaccaccaggcttgaaggcttcaagtgccgagaaagattctgttttgaatatagccagaggaaaaaaggatggagaaaaaactaagagagtgtcttctcggaaaaaaccatccttggaggccacaagtgatgagaaggattctttttcgaatataaccagagaaaaaaaggatggagaaatatctaggaaagtgtcttctcagaaaccaccagccttgaagggtacaagtgacgaggaagattctgttttgggtatagccagagaaaacaaggatggagaaaaatctaggacagtgtcttctgagaaaccaccaggcttgaaggctacaagtgatgagaaagattctgttttgaatatagccagaggaaaaaaggatggagaaaaaactaggacagtgtcttctcagaaaccaccaaccttgaaggctacaagtgatgaggaagattctgttttgagtatagccagagaaaacaaggatggagaaaaatctaggacagtgtcttctgagaaaccatcaggcttgaaggctacaagtgccgagaaagattctgttttgaatatagccagaggaaaaaagtatggagaaaaaactaagagagtgtcttctcggaaaaaaccagccttgaaggctacaagtgacgagaaagattctgttttgtatatagccagagaaaaaaaggatggagaaaaatctaggacagtgtcttctccgaaacaaccagcattgaaggctatctgtgacaaggaagattctgttccgaatatggccacggaaaaaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacaggtattttggaatacacctttaatgtaatgttcgatcaaatagaagagaaattcacttccctaaataaatcagcgggggtgtctcctcagaaacaatcggcccagaaggttatatttaaaaagaaagtttctcttttgaatattgccacaagaataacaggcggttggaaatctggaacagagtatcctgagaatctgcccaccttgaaggctacaattgaaaataaaaattctgttctgaatacagccaccaaaatgaaggatgtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaa

SEQ ID NO: 107692 - DNA, 6102 bp, Homo sapiens
  Payload ID: 1141
  Gene Symbol: ANKRD36
  Gene Name: ankyrin repeat domain 36
  Uniprot ID: A6QL64
  ENST ID: ENST00000461153
  CDS Start-End: 245-6070
gggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagtgtgaatatcagccactgttatttgctgtgagtcgaagaaaagtgaaaatggtggaatttttattaaagaaaaaagcaaatgtaaatgccattgattatcttggcagatcagccctcatacatgctgttactcttggagaaaaagatatagtcattcttcttctgcagcacaatattgatgtgctttctcgagatgcgtttcgaaagattgcaggagattatgccattgaggctaagaatagagtcatttttgatctaatttatgaatacgaaagaaagagatatgaagatcttcctataaatagcaatccagtgtcttctcagaaacaaccagccttgaaggctacaagtggcaaggaagattctatttcaaatatagccacagaaataaaggatggacaaaaatctgggacagtgtcttctcagaaacaaccggccttgaaggatacaagtgacaaggatgattctgtttcgaacacagccacagaaataaaagatgaacaaaaatctgggacagtgcttcctgctgttgaacagtgtttaaacaggagtctctacagacctgatgctgttgcacagcctgtgacagagaatgagttttctttggaatctgagattatttcaaaactatacatcccaaagagaaagattatttctccacgatctataaaagatgtgcttcctcctgttgaagaggctgttgacaggtgtctctacctactggaccgttttgcacagcctgtgacaaaggataagtttgctttggaatctgagaatatttcagaaccatactttacgaacagaaggactatttctcaacaatctgcagaaaatttagatgctgcatgtggcattgacaaaacagaaaatggaaacatgtttgaagaccaaaatgttgataaggaaggaaaagcactaccagcaactggacaaaaagcaaatgtgtctcctgagcaaccgcctttattcacgcatacggtgaaagacagagatcacatttcaactagattcttaggaggtatggattcactaacttccagtgaagaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgacgagaaagattctgtttcaaatatagccacagaaataaagaagggacaacaatctgggacagtgtctcctcagaaacaatcggcctggaaggttatatttaaaaagaaagtttctcttttgaatattgccacaagaataatgggtggtgggaaatctggaacagtgtcttctcagaaacaaccagcctcaaaggctacaagtgacaagacagattctgctttgaatatagctacagaaataaaggatggactacagtgtgggacagtgtcttctcagaaacaaccagccttgaaggctacaactgacgaggaagactctgtttcgaatatagccacagaaataaaggatggagaaaaatctgggacagtgtcttctcagaagcaaccagccttgaaggctacaactgacgaggaagattctgtttcgaatatagccacagaaataaaggatggagaaaaatctgggacagtgtcttctcagaaacaaccagccttgaaggctacaactgatgagaaagattctgtttcgaacatagccacagaaataaaggatggagaaaaatctgggacagtgtcttctcagaaaccaccagccttgacggctacaagtgacgaggaaggttctgttttgagtatagccagagaaaacaaggatggagaaaaatctaggacagtgtcttctcggaaaaaaccagccttgaaggctacaagtgatgagaaggattctttttcgaatataaccagaggaaaaaaggatggagaaatatctaggaaagtgtcttctcagaaaccaccaaccttgaagggtacaagtgacgaggaagattctgttttgggtatagccagagaaaacaaggatggagaaaaatctaggacagtgtcttctgagaaaccaccaggcttgaaggcttcaagtgccgagaaagattctgttttgaatatagccagaggaaaaaaggatggagaaaaaactaagagagtgtcttctcggaaaaaaccatccttggaggccacaagtgatgagaaggattctttttcgaatataaccagagaaaaaaaggatggagaaatatctaggaaagtgtcttctcagaaaccaccagccttgaagggtacaagtgacgaggaagattctgttttgggtatagccagagaaaacaaggatggagaaaaatctaggacagtgtcttctgagaaaccaccaggcttgaaggctacaagtgatgagaaagattctgttttgaatatagccagaggaaaaaaggatggagaaaaaactaggacagtgtcttctcagaaaccaccaaccttgaaggctacaagtgatgaggaagattctgttttgagtatagccagagaaaacaaggatggagaaaaatctaggacagtgtcttctgagaaaccatcaggcttgaaggctacaagtgccgagaaagattctgttttgaatatagccagaggaaaaaagtatggagaaaaaactaagagagtgtcttctcggaaaaaaccagccttgaaggctacaagtgacgagaaagattctgttttgtatatagccagagaaaaaaaggatggagaaaaatctaggacagtgtcttctccgaaacaaccagcattgaaggctatctgtgacaaggaagattctgttccgaatatggccacggaaaaaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacaggtattttggaatacacctttaatgtaatgttcgatcaaatagaagagaaattcacttccctaaataaatcagcgggggtgtctcctcagaaacaatcggcccagaaggttatatttaaaaagaaagtttctcttttgaatattgccacaagaataacaggcggttggaaatctggaacagagtatcctgagaatctgcccaccttgaaggctacaattgaaaataaaaattctgttctgaatacagccaccaaaatgaaggatgtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaaggtatgttgccaaaatttatgaattaa

SEQ ID NO: 107693 - DNA, 1884 bp, Homo sapiens
  Payload ID: 1141
  Gene Symbol: ANKRD36
  Gene Name: ankyrin repeat domain 36
  ENST ID: ENST00000620383
  CDS Start-End: 84-1013
tgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagtgtgaatatcagccactgttatttgctgtgagtcgaagaaaagtgaaaatggtggaatttttattaaagaaaaaagcaaatgtaaatgccattgattatcttggcagatcagccctcatacatgctgttactcttggagaaaaagatatagtcattcttcttctgcagcacaatattgatgtgctttctcgagatgcgtttcgaaagattgcaggagattatgccattgaggctaagaatagagtcatttttgatctaatttatgaatacgaaagaaagagatatgaagatcttcctataaatagcaatccagtgtcttctcagaaacaaccagccttggcaacagagcaagactccatgtcaaaaataaaaaaaagaaagttgattgttatgaaaaaaaagtcaatggtgattcagagatttttggttacattttgtaaatgaaaatctgagtactcattagttatttgatgtgtaatgcatacttttttttttgcataagtgaatgaaaagatggcaagagaactaaagttgagaatccagaagttgaaaatatcagaagccttcatgactgtggatgacatgagtatttttagaaacgatttttctccaagtagatatctaaagtaatgattgagagcatttcctgccagcagaagcgaatgatacattttcttttctttttttttgagacggagtctcactctgtcacccaggcttgagtgcagtggcgggatctcggctcactgcgaactccgcctcccgggttcacgccattctcctgcttcagcctcctgagtagctggtactacaggcgcctgccaccacacccggctaattttacgcatttttagtagagacggggtttcaccgtgttagccaggatggtctccatctcctgactttgtgatctgcccgcctcggcctcccaaagtgctgggattacaggctgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaagggtacaagtgacgaggaagattctgttttgggtatagccagagaaaacaaggatggagaaaaatctaggacagtgtcttctgagaaaccaccaggcttgaaggcttcaagtgccgagaaagattctgttttgaatatagccagaggaaaaaaggatggagaaaaaactaagagagtgtcttctcggaaaaaaccatccttggagg

SEQ ID NO: 107694 - DNA, 4297 bp, Homo sapiens
  Payload ID: 1142
  Gene Symbol: ANKRD36B
  Gene Name: ankyrin repeat domain 36B
  Uniprot ID: Q8N2N9
  ENST ID: ENST00000359901
  CDS Start-End: 37-4098
aaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagaatgaatatcagccactgttacttgctgtgagtcgaagaaaagtgaaaatggtggaatttttattaaagaaaaaagcaaatgtaaatgccattgattatcttggcagatcagccctcatacttgctgttactcttggagaaaaagatatagtcattcttcttctgcagcacaatattgatgtgttttctcgagatgtgtatggaaagcttgcagaagattatgccagtgaggctgagaatagagtcatttttgatctaatttatgaatacaaaagaaagagatatgaagatcttcctataaatagcaatccagtgtctcctcagaaacaacgagctgagaaggctacaagtgacgacaaagattctgtttcaaatatagccacagaaataaaggagggacctatatctgggacagtgtcttctcagaaacaaccagctgagaaggctacaagtgacgagaaagattctgtttcaaatatagccacagaaataaaggagggacaacaatctgggacagtgtctcctcagaaacaatcggcccagaaggttatatttaaaaagaaagtttctcttttgaatattgccacaagaataatgggcggtgggaaatctggaacagtgtcttctcagaaacaaccagcctcaaagactgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaaggatggagaaatatctaggacagtgtcttctcagaaaccaccagccttgaaggctacaagtgtcaaggaagattctgttttgaatatagccagagaaaaaaaggatggagaaaaatctaggacagtgtcttttgagcaaccaccaggcttgaaggctacaagagacgagaaagattctcttttgaatatagccagaggaaaaaaagatggagaaaaaactaggagagtgtcttctcataaacaaccatccttgaaggctacaagtgacaaggaagattctgttccgaatatggccacagaaacaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtcttctcagagacgaccagccttgaagactacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggtgggaaatctggaacagagtatcctgagaatctgcgcaccttgaaggctacaattgaaaataaagattctgttctgaatacagccaccaaaatgaaggaggtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagagttgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccgttgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaa

SEQ ID NO: 107695 - DNA, 1169 bp, Homo sapiens
  Payload ID: 1142
  Gene Symbol: ANKRD36B
  Gene Name: ankyrin repeat domain 36B
  ENST ID: ENST00000419390
  CDS Start-End: 131-646
acagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagtgtctcctcagaaacaacgagctgagaaggctacaagtgacgacaaagattctgtttcaaatatagccacagaaataaaggagggacctatatctgggacagtgtcttctcagaaacaaccagctgagaaggctacaagtgacgagaaagattctgtttcaaatatagccacagaaataaaggagggacaacaatctgggacagtgtctcctcagaaacaatcggcccagaaggttatatttaaaaagaaagtttctcttttgaatattgccacaagaataatgggcggtgggaaatctggaacagtgtcttctcagaaacaaccagcctcaaagactgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaa

SEQ ID NO: 107696 - DNA, 5986 bp, Homo sapiens
  Payload ID: 1142
  Gene Symbol: ANKRD36B
  Gene Name: ankyrin repeat domain 36B
  Uniprot ID: Q8N2N9
  ENST ID: ENST00000258459
  CDS Start-End: 281-4342
gggcgcgcgagagctgctagggcggtttctctgcctcgggcctgttgggcagggccggctaaggtgcgcgtgctcgctggttctaacccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagaatgaatatcagccactgttacttgctgtgagtcgaagaaaagtgaaaatggtggaatttttattaaagaaaaaagcaaatgtaaatgccattgattatcttggcagatcagccctcatacttgctgttactcttggagaaaaagatatagtcattcttcttctgcagcacaatattgatgtgttttctcgagatgtgtatggaaagcttgcagaagattatgccagtgaggctgagaatagagtcatttttgatctaatttatgaatacaaaagaaagagatatgaagatcttcctataaatagcaatccagtgtctcctcagaaacaacgagctgagaaggctacaagtgacgacaaagattctgtttcaaatatagccacagaaataaaggagggacctatatctgggacagtgtcttctcagaaacaaccagctgagaaggctacaagtgacgagaaagattctgtttcaaatatagccacagaaataaaggagggacaacaatctgggacagtgtctcctcagaaacaatcggcccagaaggttatatttaaaaagaaagtttctcttttgaatattgccacaagaataatgggcggtgggaaatctggaacagtgtcttctcagaaacaaccagcctcaaagactgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaaggatggagaaatatctaggacagtgtcttctcagaaaccaccagccttgaaggctacaagtgtcaaggaagattctgttttgaatatagccagagaaaaaaaggatggagaaaaatctaggacagtgtcttttgagcaaccaccaggcttgaaggctacaagagacgagaaagattctcttttgaatatagccagaggaaaaaaagatggagaaaaaactaggagagtgtcttctcataaacaaccatccttgaaggctacaagtgacaaggaagattctgttccgaatatggccacagaaacaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtcttctcagagacgaccagccttgaagactacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggtgggaaatctggaacagagtatcctgagaatctgcgcaccttgaaggctacaattgaaaataaagattctgttctgaatacagccaccaaaatgaaggaggtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagagttgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccgttgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgacacaaacctgggctagtatcccttctatgtcttccaataagtgctgtcttatgcttgtcattgtatgtatgactctgtatgggaattgcctgtttgttttttcagattatagcatacagttgttgaggggcggaccgtatcatctttatcttgtaattccagtgcttgtcctagtaccttagcacatggttgctgaatacatgaacgaagagtgagaaaccagaagctctgatacttaactgccatgataatgaattcggtgtgcaactatgggcaaattatatttaatagtaattgcatattgtacatatttttcattcttattaacactgataagcttttcagcatatactgactttctcttagttaactgtgaaatcatttagataaagaatataattctttttcattctaacttctgaatttaaatctgaatcctctatagcaggggtccccaactcccaggccacacacagttccatgacctgttaggaagcaggctgcacagcaggaggtgagtggcaggcaagcgagtgaagcttcatctgtatttccagccactccctgttgctcacattatcacctgagctctgcctcctgtcagatcagcaaagccattagattctcacaggagtgaaaatcctactgtgaactgctcgttcaagggatctaggtcacatgctccttatgagactctaatgcctgatgatatgtcattgtctcctatctcttcacgatgggaccatctagttacagaaaaacaagctcaggactcccattgattctccattatgatgagttgtgtaattatttcattatgtattacaatgtagtcataataggaataaagtgcacaatagatgtaatacgcttgaatcaccatcctgaaaccatcccccaaacccccatctgtggaaaaattatctttcacaaaactgctgcctggtgccaaaaaggctggggactgctgctctatagcttctgcactagaatctactaatgagtaaaatttaaatcaataactagttttaaaagcataacaagaatatgtgctgtctggctgcagtggctcatgcctgtattctcagcactttgggaggccagtgcaggtggatcacttgaggtcaggagttcaagaccagcctggccaatatggtgaaatcctgtctctactaaaaatacaaaaattagctgggtgtggtggtgcatgcctgtagtctcagctactcgggaggctgaggtgggagaatcacttgaacccgggaggcagaggtttcagtgagccaagatcgtgccactgcactccagcctgagcaacagagtgactccatctcaaatgcaaaacaaaacagaaagaatacatgctgacgaaaaaaatctaagacaataaaattgtattactaggctgttaacatgatattttgtttcccgttaaatgtgtgacatgcaaaagtatttattaaatgaaaatattttttatctttt

SEQ ID NO: 107697 - DNA, 649 bp, Homo sapiens
  Payload ID: 1142
  Gene Symbol: ANKRD36B
  Gene Name: ankyrin repeat domain 36B
  ENST ID: ENST00000497329
  CDS Start-End: 41-454
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataacccttt

SEQ ID NO: 107698 - DNA, 1661 bp, Homo sapiens
  Payload ID: 1142
  Gene Symbol: ANKRD36B
  Gene Name: ankyrin repeat domain 36B
  Uniprot ID: Q8N2N9
  ENST ID: ENST00000443455
  CDS Start-End: 180-899
tttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagaatgaatatcagccactgttacttgctgtgagtcgaagaaaagtgaaaatggtggaatttttattaaagaaaaaagcaaatgtaaatgccattgattatcttggcagatcagccctcatacttgctgttactcttggagaaaaagatatagtcattcttcttctgcagcacaatattgatgtgttttctcgagatgtgtatggaaagcttgcagaagattatgccagtgaggctgagaatagagttgtctcctcagaaacaacgagctgagaaggctacaagtgacgacaaagattctgtttcaaatatagccacagaaataaaggagggacctatatctgggacagtgtcttctcagaaacaaccagctgagaaggctacaagtgacgagaaagattctgtttcaaatatagccacagaaataaaggagggacaacaatctgggacagtgtctcctcagaaacaatcggcccagaaggttatatttaaaaagaaagtttctcttttgaatattgccacaagaataatgggcggtgggaaatctggaacagtgtcttctcagaaacaaccagcctcaaagactgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaaggatggagaaatatctaggacagtgtcttctcagaaaccaccagccttgaaggctacaagtgtcaaggaagattctgttttgaatatagccagagaaaaaaaggatggagaaaaatctaggacagtgtcttttgagcaaccaccaggcttgaaggctacaagagacgagaaagattctcttttgaatatagccagagg

SEQ ID NO: 107699 - DNA, 6067 bp, Homo sapiens
  Payload ID: 1142
  Gene Symbol: ANKRD36B
  Gene Name: ankyrin repeat domain 36B
  ENST ID: ENST00000438709
  CDS Start-End: 1325-4423
gggcgcgcgagagctgctagggcggtttctctgcctcgggcctgttgggcagggccggctaaggtgcgcgtgctcgctggttctaacccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagaatgaatatcagccactgttacttgctgtgagtcgaagaaaagtgaaaatggtggaatttttattaaagaaaaaagcaaatgtaaatgccattgattatcttggcagatcagccctcatacttgctgttactcttggagaaaaagatatagtcattcttcttctgcagcacaatattgatgtgttttctcgagatgtgtatggaaagcttgcagaagattatgccagtgaggctgagaatagagtcatttttgatctaatttatgaatacaaaagaaagagatatgaagatcttcctataaatagcaatccagtgtctcctcagaaacaacgagctgagaaggctacaagtgacgacaaagattctgtttcaaatatagccacagaaataaaggagggacctatatctgggacagtgtcttctcagaaacaaccagctgagaaggctacaagtgacgagaaagattctgtttcaaatatagccacagaaataaaggagggacaacaatctgggacagtgtctcctcagaaacaatcggcccagaaggttatatttaaaaagaaagtttctcttttgaatattgccacaagaataatgggcggtgggaaatctggaacagtgtcttctcagaaacaaccagcctcaaagactgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaaggatggagaaatatctaggacagtgtcttctcagaaaccaccagccttgaaggctacaagtgtcaaggaagattctgttttgaatatagccagagaaaaaaaggatggagaaaaatctaggacagtgtcttttgagcaaccaccaggcttgaaggctacaagagacgagaaagattctcttttgaatatagccagaggaaaaaaagatggagaaaaaactaggagagtccgggtagataagaaattctcttccctgaataaatctgcggggggctcgttgaagctgcacattctgattcagcataagggtggaaggagaaagagaggaatgtcttctcataaacaaccatccttgaaggctacaagtgacaaggaagattctgttccgaatatggccacagaaacaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacaggtattttggaatacacctttaatgtaatgttcgatcaaatagaagagaaattcacttccccaaataaatcagcggggggtgtgtctcctcagaaacaatcggcccagaaggttatatttaaaaagaaagtttctcttttgaatattgccacaagaataacgggcggtgggaaatctggaacagagtatcctgagaatctgcgcaccttgaaggctacaattgaaaataaagattctgttctgaatacagccaccaaaatgaaggaggtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagagttgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccgttgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgacacaaacctgggctagtatcccttctatgtcttccaataagtgctgtcttatgcttgtcattgtatgtatgactctgtatgggaattgcctgtttgttttttcagattatagcatacagttgttgaggggcggaccgtatcatctttatcttgtaattccagtgcttgtcctagtaccttagcacatggttgctgaatacatgaacgaagagtgagaaaccagaagctctgatacttaactgccatgataatgaattcggtgtgcaactatgggcaaattatatttaatagtaattgcatattgtacatatttttcattcttattaacactgataagcttttcagcatatactgactttctcttagttaactgtgaaatcatttagataaagaatataattctttttcattctaacttctgaatttaaatctgaatcctctatagcaggggtccccaactcccaggccacacacagttccatgacctgttaggaagcaggctgcacagcaggaggtgagtggcaggcaagcgagtgaagcttcatctgtatttccagccactccctgttgctcacattatcacctgagctctgcctcctgtcagatcagcaaagccattagattctcacaggagtgaaaatcctactgtgaactgctcgttcaagggatctaggtcacatgctccttatgagactctaatgcctgatgatatgtcattgtctcctatctcttcacgatgggaccatctagttacagaaaaacaagctcaggactcccattgattctccattatgatgagttgtgtaattatttcattatgtattacaatgtagtcataataggaataaagtgcacaatagatgtaatacgcttgaatcaccatcctgaaaccatcccccaaacccccatctgtggaaaaattatctttcacaaaactgctgcctggtgccaaaaaggctggggactgctgctctatagcttctgcactagaatctactaatgagtaaaatttaaatcaataactagttttaaaagcataacaagaatatgtgctgtctggctgcagtggctcatgcctgtattctcagcactttgggaggccagtgcaggtggatcacttgaggtcaggagttcaagaccagcctggccaatatggtgaaatcctgtctctactaaaaatacaaaaattagctgggtgtggtggtgcatgcctgtagtctcagctactcgggaggctgaggtgggagaatcacttgaacccgggaggcagaggtttcagtgagccaagatcgtgccactgcactccagcctgagcaacagagtgactccatctcaaatgcaaaacaaaacagaaagaatacatgctgacgaaaaaaatctaagacaataaaattgtattactaggctgttaacatgatattttgtttcccgttaaatgtgtgacatgcaaaagtatttattaaatgaaaatattttttatctttt

SEQ ID NO: 107700 - DNA, 2272 bp, Homo sapiens
  Payload ID: 1143
  Gene Symbol: ANKRD36C
  Gene Name: ankyrin repeat domain 36C
  Uniprot ID: Q5JPF3
  ENST ID: ENST00000295246
  CDS Start-End: 206-2062
tagatgctgcatgtggcattgacaaaacagaaaatggaaccttgtttgaagaccaaaatgttgataaggaaggaaaagcactaccagcaactggacaaaaagcaaatgtgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgatgagaaagattctgtttcaaatatagccacagaaataaaggagggacaacaatctgggacagtgtctcctcagaaacaatcagcctggaaggttatatttaaaaagaaagtttctcttttgaatattgccacaagaataacgggcggtgggaaatctggaacagtgtcttctcagaaacaaccaccctcaaaggctacaagtgacaagacagattctgctttgaatatagctacagaaataaaggatggactacaatgtgggacagtgtcttctcagaaacaaccagccttgaaggctacaactgacgaggaagattctgtttcgaatatagccacagaaataaaggatggagaaaaatctgggacagtgtcttctcagaaacaaccagccttgaaggctacaactgacgaggaagattctgtttcgattatagccacagaaataaaggacggagaaaaatctgggacagtgtcttctcggaaaaaaccagccttgaaggctacaagtgatgagaaagattctttttcgaatataaccagagaaaaaaaggatggagaaatatctaggacagtgacttctgagaaaccagcaggcttgaaggctacaagtgacgaggaagattctgttttgaatatagccagaggaaaagaggatggagaaaaaactaggagagtgtcttctcggaaaaaaccagccttgaaggctacaagtgatgagaaagattctttttcgaatataaccagagaaaaaaaggatggagaaacatctaggacagtgtcttctcagaaaccaccagccttgaaggctacaagtgacgaggaagattctgttttgaatatagccagagaaaaaaaggatggagaaaaatctagaacagtgtcttctgagaaaccatcaggcttgaaggctacaagtgacgagaaagattctgttttgaatatagccagaggaaaaaagcatggagaaaaaactaggagagtgtcttctcataaacaaccagccttgaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacatccacaccagaacaagacttagaaatggcatcagagggagagcaaaagaggcttgaagaatatgaaaataaccagccacagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagc

SEQ ID NO: 107701 - DNA, 5428 bp, Homo sapiens
  Payload ID: 1143
  Gene Symbol: ANKRD36C
  Gene Name: ankyrin repeat domain 36C
  Uniprot ID: Q5JPF3
  ENST ID: ENST00000456556
  CDS Start-End: 86-5422
tttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggatgaatatccgccactgttccttgctgtgagtcaaagaaaagtgaaaatggtggaatttttattaaagaaaaaagcaaatataaatgccgttgattatcttggcagatcagccctcatacatgctgttactcttggagaaaaagatatagtcattcttcttctgcagcacaatattgatgtgttttctcgagatgtgtatggaaagcttgcagaagattatgccagcgaggctaagaacagagtcatttttgaactaatttatgaatatgaaagaaagaaacatgaagagctttctataaatagcaatccagtgtcttctcagaaacaaccagccttgaaggctacaagtggcaaggaagattctatctcgaatatagccacagaaataaaggatggacaaaaatctgggacagtgtcttctcagaaacaaccggccttgaagggtacaagtgacaagaacgattctgtttcgaacacagccacagaaataaaagatgaacaaaaatctgggacagtgtcttctcagaaacaaccggccttgaaggatacaagtgacaagaacgattctgtttcgaacacagccacagaaataaaagatgaacaaaaatctgggacagtgcttcctgctgttgaacagtgtttaaacaggagtctctacagaccggatgctgttgcacagcctgtgacagaggatgagtttgctttggaatctgagattatttcaaaactatacatcccaaagagaaagattatttctccacgatctatagaagatgtgcttcctcctgttgaagaggctgttgacaggtgtctctacctactggaccgttttgcacaggctgtgacaaaggataagtttgctttggaatctgagaatatttcagaaccatactttacaaacagaaggactatttctcaacaatctgcagaaaagttagatgctgcatgtggcattgacaaaacagaaaatggaaccttgtttgaagaccaaaatgttgataaggaaggaaaagcactaccagcaactggacaaaaagcaaatgtgtctcctgagcaaccgcctttattcacgcatacggtgaaagacagtgatcacatttcaactagattcttaggaagtatggattcactaacttccagtgaagaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgatgagaaagattctgtttcaaatatagccacagaaataaaggagggacaacaatctgggacagtgtctcctcagaaacaatcagcctggaaggttatatttaaaaagaaagtttctcttttgaatattgccacaagaataacgggcggtgggaaatctggaacagtgtcttctcagaaacaaccaccctcaaaggctacaagtgacaagacagattctgctttgaatatagctacagaaataaaggatggactacaatgtgggacagtgtcttctcagaaacaaccagccttgaaggctacaactgacgaggaagattctgtttcgaatatagccacagaaataaaggatggagaaaaatctgggacagtgtcttctcagaaacaaccagccttgaaggctacaactgacgaggaagattctgtttcgattatagccacagaaataaaggacggagaaaaatctgggacagtgtcttctcggaaaaaaccagccttgaaggctacaagtgatgagaaagattctttttcgaatataaccagagaaaaaaaggatggagaaatatctaggacagtgacttctgagaaaccagcaggcttgaaggctacaagtgacgaggaagattctgttttgaatatagccagaggaaaagaggatggagaaaaaactaggagagtgtcttctcggaaaaaaccagccttgaaggctacaagtgatgagaaagattctttttcgaatataaccagagaaaaaaaggatggagaaacatctaggacagtgtcttctcagaaaccaccagccttgaaggctacaagtgacgaggaagattctgttttgaatatagccagagaaaaaaaggatggagaaaaatctagaacagtgtcttctgagaaaccatcaggcttgaaggctacaagtgacgagaaagattctgttttgaatatagccagaggaaaaaagcatggagaaaaaactaggagagtgtcttctcataaacaaccagccttgaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacatccacaccagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaaatgttgaagagttgcaccaaaaagttagggaaaagttaagaatcacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaatttcaagaaatacaggatcaacttacagctactataagatgtactaaggagatggaaggcgacgcacaaaagcttgaagtagaaaatgtcatgatgagaaaaattattaaaaaacaggatgaacaaattgagcggtttgagaaaatcctgcagcattcaagtttgatgctgcaggtgtttgagagctagatgaag

SEQ ID NO: 107702 - DNA, 1907 bp, Homo sapiens
  Payload ID: 1143
  Gene Symbol: ANKRD36C
  Gene Name: ankyrin repeat domain 36C
  ENST ID: ENST00000528268
  CDS Start-End: 86-1684
tttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggatgaatatccgccactgttccttgctgtgagtcaaagaaaagtgaaaatggtggaatttttattaaagaaaaaagcaaatataaatgccgttgattatcttggcagatcagccctcatacatgctgttactcttggagaaaaagatatagtcattcttcttctgcagcacaatattgatgtgttttctcgagatgtgtatggaaagcttgcagaagattatgccagcgaggctaagaacagagtcatttttgaactaatttatgaatatgaaagaaagaaacatgaagagctttctataaatagcaatccagtgtcttctcagaaacaaccagccttgaaggctacaagtggcaaggaagattctatctcgaatatagccacagaaataaaggatggacaaaaatctgggacagtgtcttctcagaaacaaccggccttgaagggtacaagtgacaagaacgattctgtttcgaacacagccacagaaataaaagatgaacaaaaatctgggacagtgtcttctcagaaacaaccggccttgaaggatacaagtgacaagaacgattctgtttcgaacacagccacagaaataaaagatgaacaaaaatctgggacagtgcttcctgctgttgaacagtgtttaaacaggagtctctacagaccggatgctgttgcacagcctgtgacagaggatgagtttgctttggaatctgagattatttcaaaactatacatcccaaagagaaagattatttctccacgatctatagaagatgtgcttcctcctgttgaagaggctgttgacaggtgtctctacctactggaccgttttgcacaggctgtgacaaaggataagtttgctttggaatctgagaatatttcagaaccatactttacaaacagaaggactatttctcaacaatctgcagaaaagttagatgctgcatgtggcattgacaaaacagaaaatggaaccttgtttgaagaccaaaatgttgataaggaaggaaaagcactaccagcaactggacaaaaagcaaatgtgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgatgagaaagattctgtttc

SEQ ID NO: 107703 - DNA, 2301 bp, Homo sapiens
  Payload ID: 1143
  Gene Symbol: ANKRD36C
  Gene Name: ankyrin repeat domain 36C
  ENST ID: ENST00000534304
  CDS Start-End: 1-184
agaaaagttagatgctgcatgtggcattgacaaaacagaaaatggaaccttgtttgaagaccaaaatgttgataaggaaggaaaagcactaccagcaactggacaaaaagcaaatgtgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgatgagaaagattctgtttcaaatatagccacagaaataaaggagggacaacaatctgggacagtgtctcctcagaaacaatcagcctggaaggttatatttaaaaagaaagtttctcttttgaatattgccacaagaataacgggcggtgggaaatctggaacagtgtcttctcagaaacaaccaccctcaaaggctacaagtgacaagacagattctgctttgaatatagctacagaaataaaggatggactacaatgtgggacagtgtcttctcagaaacaaccagccttgaaggctacaactgacgaggaagattctgtttcgaatatagccacagaaataaaggatggagaaaaatctgggacagtgtcttctcagaaacaaccagccttgaaggctacaactgacgaggaagattctgtttcgattatagccacagaaataaaggacggagaaaaatctgggacagtgtcttctcggaaaaaaccagccttgaaggctacaagtgatgagaaagattctttttcgaatataaccagagaaaaaaaggatggagaaatatctaggacagtgacttctgagaaaccagcaggcttgaaggctacaagtgacgaggaagattctgttttgaatatagccagaggaaaagaggatggagaaaaaactaggagagtgtcttctcggaaaaaaccagccttgaaggctacaagtgatgagaaagattctttttcgaatataaccagagaaaaaaaggatggagaaacatctaggacagtgtcttctcagaaaccaccagccttgaaggctacaagtgacgaggaagattctgttttgaatatagccagagaaaaaaaggatggagaaaaatctagaacagtgtcttctgagaaaccatcaggcttgaaggctacaagtgacgagaaagattctgttttgaatatagccagaggaaaaaagcatggagaaaaaactaggagagtgtcttctcataaacaaccagccttgaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacatccacaccagaacaagacttagaaatggcatcagagggagagcaaaagaggcttgaagaatatgaaaataaccagccacagattgtgttcacctattgaaaattaaaaagacattttgtttatgtaaaagattaacagaacttaaagataatcactgtgagcaacttagagtaaaaattcgaaaactgaaaaataaggctagtgtactacaaaagagactatctgaaaaagaagaaataaaatcgcagttaaagcatgaaacacttgaattggaaaaagaactctgtagtttgagatttgccatacagcaagaaaaaaagaaaagaagaa

SEQ ID NO: 107704 - DNA, 737 bp, Homo sapiens
  Payload ID: 1143
  Gene Symbol: ANKRD36C
  Gene Name: ankyrin repeat domain 36C
  ENST ID: ENST00000619511
  CDS Start-End: 124-615
gcgctgagagtctgtgcgaaggtccgtggacagactgctttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggtataggtcaaccaatgttattttcaaactatctgaaatgcatttattttaacattgacacatgtaagggtcaatttttcatatttggaagctcaaacattccttgaatgaaaatattttgaaatgcc

SEQ ID NO: 107705 - DNA, 650 bp, Homo sapiens
  Payload ID: 1143
  Gene Symbol: ANKRD36C
  Gene Name: ankyrin repeat domain 36C
  ENST ID: ENST00000612359
  CDS Start-End: 41-454
gtgcagaaagcaccgtctcttactagaagaagacaataaaatgttggtgaatgaattgaatcattcgaaagaaaaaaaatgccaatatgaaaaagagaaagcagaaagagaagtagctgtgagacagcttcaacaaaaacaagatgatgtcttaaacaaacgatcagcaacaaaagctttgctggatgcttcatcgcgtcactgcatctatttagaaaatgggatgcaggattcaaggaagaaattagaccagatgagaagtcaatttcaagaaatacaggatcaacttacagctactataagatgtactaaggagatggaaggcgacgcacaaaagcttgaagtagaaaatgtcatgatgagaaaaattattaaaaaacaggatgaacaaattgagcggtttgagaaaatcctgcagcattcaagtttgatgctgcaggtgtttgagagctagatgaagatatggacatttctggaattacagagccccctctacattgagcacaagacagtgacgaatccacattcttcagccagaaagtcacctctgagagccaaatgtctgataatagacaagagagtcagagaatgataacgacatctcaggaaaattgtgaaaataatcagcaaccgtatgtggataacccttt

SEQ ID NO: 107706 - DNA, 1141 bp, Homo sapiens
  Payload ID: 1144
  Gene Symbol: ANKRD37
  Gene Name: ankyrin repeat domain 37
  Uniprot ID: Q7Z713
  ENST ID: ENST00000335174
  CDS Start-End: 441-917
gcggccgcggagccccacccgctcctactccagtcctctcacgcccactgacttaccctgcgcacgcgcgctgaggctccgtggggccgccgcgggccccgccccgaggtgggagggcctgacgcatccacagctggccaatcggcggatggcctcgcgcgcccgccccctccccctgcccccggcgccgggctccacgtgccagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaa

SEQ ID NO: 107707 - DNA, 605 bp, Homo sapiens
  Payload ID: 1144
  Gene Symbol: ANKRD37
  Gene Name: ankyrin repeat domain 37
  ENST ID: ENST00000507753
  CDS Start-End: 473-605
ccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgctt

SEQ ID NO: 107708 - DNA, 976 bp, Homo sapiens
  Payload ID: 1145
  Gene Symbol: ANKRD39
  Gene Name: ankyrin repeat domain 39
  Uniprot ID: Q53RE8
  ENST ID: ENST00000393537
  CDS Start-End: 109-660
gcggacgccgagcggccagatcagggacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaa

SEQ ID NO: 107709 - DNA, 4965 bp, Homo sapiens
  Payload ID: 1145
  Gene Symbol: ANKRD39
  Gene Name: ankyrin repeat domain 39
  Uniprot ID: Q53RE8
  ENST ID: ENST00000443120
  CDS Start-End: 28-579
ggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaaggtagcacaggttgggtgagtcggctggcagcagctgcagctgcaggagcgctgccttcagtgtgttcaagtcctggcctaggaggctgcagggattttcactcttatgggcatgaatccagtggcacctgcagacggaggagagggagcggcccatcgcgtggtgggggaagtggcaattccattcagggacctggccctgggaaggggaccgcgtggggtctctaggggtggctgcactccctctgcctaatcttccatctctgccctcagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggtaaggcaggcgcttggtcttttccggctcggacagctccagaggagcagggactgaggagccccagccaggaccagaggtgctgtctgctcggtgacagcagccctgaccttcctgcatgaggagggcagcacgcggaggcagaagcttgactgcctgcgttctcagcaggaaggggacacggctctgcacgaggccgtgcggcacggcagctacaaagccatgaagctactgctgctctatggggccgagctgggggtgcggaacgcggtgagtgtgggcgcagccctggctcctgacccgagggcgggtggagcgcctgcaagggactgacccacaccgttgctcccaggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacagcctagccgtctttcctgggccgagaggagcccatgcttcagtcaccagggactgtctgatagggcccacgcctgttagccatgccggccgacagcaagataggccgagtgcagagtgggcgggatgcggggtcctggcactaggcttttgtgcttaaggcacctctgctcactgacgacaaggtcaaagagcagtggttctccacctcagctgcttatcagaatcaccaggaaggtttaaaaagtcctgatgtccagaccctaagtcagaagccctgaggggaggatccaggtattctcatgcagaggccatgcttgtctatgtgggaaatcctaggaatctacagaaagcagacaactagggagtccagcaaaatctcgggtgcaagataaacacacaaaaacctgtttctacctcctagaaatgaacatgtagacacaaaagttaaaaatatgtactgtttacaattgctgaaaaagggaaatacttcggtttaaatctaacaaaatatgcaaggacttgtatgctgaaaattataaaacgtgatgaaatcaaagatttaaatagacatgccatgttcatggattgctagacagaatacagtaaagatatcaattctcctcaaattaacatacaggttaaatgcagttcctatcaaaatcctagaagatgttttgtagatgtagacaaggttattctaaaattcatatacaaatttatagcaaaaatattttgaaaaagaatagagtgagaggaggaatcagtccagctgatttcaagatctactatatagctatgtgaaccaagagtgcaatgctggcagaggcacagacacacagatcgacagagccgagatcatcacgggaacaggaccacacaaatatgcccagctgactttaaggtgcaaaagtaattcaatggaggaaggacagcctttcaacaaacggtgctggagcagctggaccagctataggattaaaaaaaaagaactttagcctaagtcttacacattatacaaaaattaacatggctcacatgcatacttaaatttaaaactataaaacttcttttaggaaaaaacagataacctttgggatctaagactaggtagagttgttcttaaatgcaacactaaaagcaacagtccataaaggaaatatcagtaaagtggactttatcaaaactgaaaacttttgctctgtataaaaccctgttaagagggtgaaaagatggccgggcacggtggctcacacctgtaattgtagtactttgggaggttgaggcaggcagatcacttgag

SEQ ID NO: 107710 - DNA, 4184 bp, Homo sapiens
  Payload ID: 1146
  Gene Symbol: ANKRD40
  Gene Name: ankyrin repeat domain 40
  Uniprot ID: Q6AI12
  ENST ID: ENST00000285243
  CDS Start-End: 271-1377
ttgtcacactgaacagggtcccccggagccggccttcgggaggcgcggcccgggaggaggcctgggcctgcgggccgggagcagcaggggcggcccgcgggagggagcggaagtcccggggcgggcgcgggcagcggcgcgagcagggcgggcgagttccgcgctccctccccatggccgggagcgggccgcggcgacggcggcggcgctgacaggccccgggcggggcggggcaggcgggcctgggcgggggcctggggctgtgggaagatgaacgccctcctagagcagaaggagcagcaggagaggctgcgggaggccgcggccttaggggacattcgggaggtgcagaaactggtggagagcggggtggatgtgaactcccaaaatgaggtcaacggctggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccccacccccaccccgcccatagagacagggtctcactatgtggcccaggctggtctcaaacttctggccttaagtgatgctcctgtccttggcctcccaaagtgctgggattacaggtgtgagccactgcacccagcccactttttttttactctgaagtgattccagtcatatgtgtgtgtaactgcatcctatgagaagagcacaaatattgctgttccatgttctccactttcattttccactacaaatgaaaagcaatttttgagactgaatctgttgctattttaaaggttattgtgggaaactgagctaaaggagttagcatctttatttttgtatcaaaaataaaggttattttgaaattattaggatttttacacaattctgaaatctgttgcttttgtaaacaaattgtttgatcttagtgatccccctactactaccaccaattcacttcacaaagtcagttatgagtctaccagactttgttctgaaaaatagaaacaaaacacctgattaagctcttgagtatggcataggaattttttagaagaatgcattcaaggattcttttcctttccttcagtgtcattaatgttaaaagagcagccactgttttgttgaaacaaacagcttaacttcagaaataagaactagcacacttagacaaacaggagagcaggggtttgaagccagctgtcgaagagcatccctgctgtcttaagaagctttttccccatagtgcctatagtttccaaagaaactcaacttcctaactgtgttaacttaattttattagaacactacagttgagtgagaacgtgcagaagatgtcaacagaagagaatgttgtgctaagataatggcctcctgctgctgcctaaatgctgaaatgaggttgagatgtttttcaaggctaacttcatggactcactctgtttagtgacttaattgtatcccaccaattactgctggtgacttactcacccttgtacagtgtttgcatagcagagtgaaggttacttattaccctctttctctcaagtgctttaaagaagaaacctccctggtgtttcttttctttttttttttgagacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggccaggctggtctcgaactcctggcctcaagtgatccacctgccttggcctcccaaagtgctccgattacaggtgtgagccacccggcccagcccctcccttgtgtttcaaccaatcggaagtgaatttaactagatgtagtaaccttttttttctttacttctaaaacagttacagtttactaataaagttaagtctggttctgtcctagaggaaataaattcactattaattcatgtcttaagttacttgggttaaaacactttcagccacccagattaattaaagtggagcagtggagcccctggctgggagatggcctccagaggagcagctgcagggcatgttctgggcttagcgacagaggcaagcaagggactggtgtctctggtgagaggtgggtttgatgtatctctgtcctatgctggtctctcttctcctttataaaatcctctgtggtcaactgactactgcgtatcgcagtggaataagactgcacagttgctggtaggtgagtttaaagtcttaatctatgcattcagagaaatatttttatatgctttgtgtaatttataacaaggattttttttttagctttgttaactgtgaattcacccctcctcctccactgcatatttaaagcatgtgttcacactgtgtgtaaacattcactgaagattttttctttgtgcattgctgactgttcaaacataacaagtattattaaaattaaatattaactgaccgatccta

SEQ ID NO: 107711 - DNA, 848 bp, Homo sapiens
  Payload ID: 1146
  Gene Symbol: ANKRD40
  Gene Name: ankyrin repeat domain 40
  ENST ID: ENST00000513072
  CDS Start-End: 483-848
tccatagtccctgaaaaggaatatagcaatagaaaaatatgtttcagagactgagatgatctaatgagcgatactgatagagtatattccacggtatcattggagttagccagccagtgagcttaccttctggaggctattgaaattaaaactcctaggttaagttagtttttctcaggagccagaaatgaaatttaaaaacaaaatttaagcatattaaatattttgctcatcggctttgtgaaaagttgagattaccagcccggttacctggttctagctgaactctaacaggcttgtttatacattatttactaatgtttagaatctgaaatccaaaatcacttctcctctttttcaatcattattttctttggtacaggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacacca

SEQ ID NO: 107712 - DNA, 2514 bp, Homo sapiens
  Payload ID: 1147
  Gene Symbol: ANKRD42
  Gene Name: ankyrin repeat domain 42
  ENST ID: ENST00000260047
  CDS Start-End: 796-2349
tggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataaatgtgagtctatacaaactatctcagaattactctgatatgcttctgttccaattctgatggcagaaatgttatattaaagagatttagagattttttaaatga

SEQ ID NO: 107713 - DNA, 4066 bp, Homo sapiens
  Payload ID: 1147
  Gene Symbol: ANKRD42
  Gene Name: ankyrin repeat domain 42
  Uniprot ID: Q8N9B4
  ENST ID: ENST00000393389
  CDS Start-End: 933-1529
gcctctccagccaagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagaacctccttagatccctgtggagcctctgattccttggcttggcatgctggacttacataatttggcacctacctacctgcatggcctcatctttctatatctttacactactgtccaggatcattttgtttttttctgaaggtcgtctttcagtgttcatttagtgaagtcttttggtatgaactctttcaatttttgtgtatctgaaaatttattttgttctcattctttttactttgtattttgtaagtttttttttttaaagtaaaatttaaattgaagtctcaaaaaacaaaaagcccctctctcggcgctgcctacggaggtggcagccatctcctcctcagcatcatggccaccctcagaccccttgtgaagcccaggatcatcaaaaagagaactaagaagttcttccggcaccagactgactgatatgtcaaaattaagtgtaactggcagaaacccagaggtattgacaacagggttcgtagaaggttcaaggaccaatcttgatgcccaacattggttgtgggagcgacaaaaaaaacaaagcacatgctgcctactgacttctggaagttcctggtccacaacatcaaggagctggaagtgctgctgatgtgcaacagatcttactgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcataaaattattttttattgataaatgtacatatttttggtgtacatgtgataatttgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagtta

SEQ ID NO: 107714 - DNA, 2302 bp, Homo sapiens
  Payload ID: 1147
  Gene Symbol: ANKRD42
  Gene Name: ankyrin repeat domain 42
  Uniprot ID: Q8N9B4
  ENST ID: ENST00000393392
  CDS Start-End: 163-1332
agcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtgtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtcttttttgatttgggctactcatttaacctttttgtgcctcaactataaactggagatgataacttatactttctagagctgatgacaggattaaaggaatacacacacacacacacacacacacacacacacacacacactctatatgtaactataactttctagatacatacacacatctgtctatctatcttcaaacagcagcctagttcataagtattattgttaacattgtaccatagaaggagaaaatgttttcataagtaatcaatcagaattctaagacagctagaggatatgtatattttaatattctaaataaccaaaataaagtgctttgaatggaatccatattttctttccatagggaagtttcttcatcaatcatcatggatgaattaattctgtttgaggcttgtgtcacctcaaatctgatctattaatattatagaatcttcctggcttctttttattttgcacaaactagtcattggtctctttaataaccactttaaaaatattaaaataataaaacatgtttgttgtatagtgttaaaaacaagatagatgttccttctgacactaagttccactctccagaggaagctattgttaacaatttagtacataccatattagacaaaattctatttatctgcaaacatgtatgtgtatttctatgcatatgcaaatataaccacttcctcagtttctctgggttttggtgtctcaccagtggttgattttccaagaaatataattaactataataatt

SEQ ID NO: 107715 - DNA, 954 bp, Homo sapiens
  Payload ID: 1147
  Gene Symbol: ANKRD42
  Gene Name: ankyrin repeat domain 42
  ENST ID: ENST00000528722
  CDS Start-End: 566-823
aagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagaacctccttagatccctgtggagcctctgattccttggcttggcatgctggacttacataatttggcacctacctacctgcatggcctcatctttctatatctttacactactgtccaggatcattttgtttttttctgaag

SEQ ID NO: 107716 - DNA, 3230 bp, Homo sapiens
  Payload ID: 1147
  Gene Symbol: ANKRD42
  Gene Name: ankyrin repeat domain 42
  ENST ID: ENST00000526731
  CDS Start-End: 423-1115
agggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccaggtggcagccatctcctcctcagcatcatggccaccctcagaccccttgtgaagcccaggatcatcaaaaagagaactaagaagttcttccggcaccagactgactgatatgtcaaaattaagtgtaactggcagaaacccagaggtattgacaacagggttcgtagaaggttcaaggaccaatcttgatgcccaacattggttgtgggagcgacaaaaaaaacaaagcacatgctgcctactgacttctggaagttcctggtccacaacatcaaggagctggaagtgctgctgatgtgcaacagatcttactgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcataaaattattttttattgataaatgtacatatttttggtgtacatgtgataatttgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagtta

SEQ ID NO: 107717 - DNA, 1887 bp, Homo sapiens
  Payload ID: 1147
  Gene Symbol: ANKRD42
  Gene Name: ankyrin repeat domain 42
  ENST ID: ENST00000531895
  CDS Start-End: 274-1782
gaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatgacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataa

SEQ ID NO: 107718 - DNA, 594 bp, Homo sapiens
  Payload ID: 1147
  Gene Symbol: ANKRD42
  Gene Name: ankyrin repeat domain 42
  ENST ID: ENST00000531815
  CDS Start-End: 1-429
gatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggaagacagcgcttcttgtgagtcaaacaaagagaagaggcgagtaaaaaaaaaggtttcttctggaggggtgtttgtgagaaggtactaatcagtgaaataactaaattgacctgctagatttttctctttcattaaaaaaattgatataaatgtgagtctatacaaactatctcagaattactctgatatgcttctgttccaattctgatggcagaaatgttatattaaagagatttagagattttttaaatga

SEQ ID NO: 107719 - DNA, 1949 bp, Homo sapiens
  Payload ID: 1147
  Gene Symbol: ANKRD42
  Gene Name: ankyrin repeat domain 42
  ENST ID: ENST00000533342
  CDS Start-End: 27-1610
ctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggctcttataatgaatggagcaaatctgacagcccaggatgaccggggatgcactcctttacatcttgctgcaactcatggacattctttcactttacaaataatgctccgaagtggagtggatcccagtgtgactgataagagagaatggagacctgtgcattatgcagcttttcatgggcggcttggctgcttgcaacttcttgttaaatggggttgtagcatagaagatgtggactacaatggaaaccttccagttcacttagcagccatggaaggccaccttcactgtttcaaattcctagtcagtagaatgagcagtgcgacgcaagttttaaaagctttcaatgataatggagaaaatgtactggatttggcccagaggttcttcaagcagaacattttacagtttatccagggggctgagtatgaaggaaaagacctagaggatcaggaaactttagcatttccaggtcatgtggctgcctttaagggtgatttggggatgcttaagaaattagtggaagatggagtaatcaatattaatgagcgtgctgataatggatcaactcctatgcataaagctgctggacaaggccacatagagtgtttgcagtggttaattaaaatgggagcagacagtaatattaccaacaaagcaggggagagacccagtgatgtggcaaagaggtttgcccatttggcagcagtgaagctgttagaggagctacagaaatatgatatagatgacgaaaatgaaattgatgaaaatgatgtgaaatattttataagacatggtgttgagggaagcactgatgccaaggatgatttatgtctgagtgacttggataaaacagatgccagaatgagagcttacaagaaaattgtagaattgagacacctcctggaaattgccgagagcaactataaacacttgggaggcataacagaagaagatttaaagcagaagaaagaacagcttgagtctgaaaagaccatcaaagaactgcagggccagctggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtcttttttgatttgggctactcatttaacctttttgtgcctcaactataaactggagatgataacttatactttctagagctgatgacaggattaaaggaatacacacacacacacacacacacacacacacacacacacactctatatgtaactataactttctagatacatacacacatctgtctatctatcttcaaacagcagcctagttcataagtattattgttaacattgtaccatagaaggagaaaatgttttcataagtaatcaatcagaattctaagacagctagaggatatgtatattttaatattctaaataaccaaaataaagtgctttgaatggaa

SEQ ID NO: 107720 - DNA, 6104 bp, Homo sapiens
  Payload ID: 1148
  Gene Symbol: ANKRD44
  Gene Name: ankyrin repeat domain 44
  Uniprot ID: Q8N8A2
  ENST ID: ENST00000282272
  CDS Start-End: 194-3175
tgcaaaccccactagccagtgtcagcctctcggcgggaggaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttggccaaaggggcaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatgcttctaggtcaaatggaccccgttccacacctggaaccgctgtacaaaaagaagaatgagactctttaaaaattatgcacatacacatgcacacatatatgtgtgcgtgtgtatatatatatatatgtgtgtgtgtgtgtagttcatcagccagctacacatgaggaccaaaatgcttcagtctaaaatggaagatacacatttttttccttcaaaatgcaagtgagaactgaagtagcttttttatggagttaaatgtaatctttctgtgtaccagtctttgttgtattttatatttcttaggacacagatttctagttgaccacttaacatttgtaactgatgatgtgctgacctttttttttttttttgccaaactagagaaaatgtccatatacttttgctgtaaatgtgtttatatttatttgaaatgaaacaaatggtgaggaaacatccattatttgttctctattttaattgctatgtatcttatttagaataacaaaaaaaaagtgaaaaaaaaaacacttgaccctgggctagccaaaagcccaagggccaaacctagcatttccactgctaaggtttccagatgaccctcaggttcttccgcgttggttagagagggctacgcatcttctactgctcagccacagtctgtagccagcttagagcttagaagacattgcagtctggatgcccttctgcgagatgaaaactcagatgtgtagtggatcatatacacaaaggcagcacaaagaaatatctagaaattaccctaagtacactgaaaagctcacatagtctcagtaacctgatgagaaatgatggcagtgtgtgggcacatgtgccaaaaggagaaataaaaatcaccagctcaagtgctattttctacttgaggaagagacagaaaagaaatgtgtcgaattagagcagtactctctgacgttttataatgagttccatttccaccctggaaattgctattttatagtgtatgtgagatatttcaaaaataatgttctatcatatctggatcaaagacagataactgtattatatttttcatctagctataaaactttaatcttactcttaatatcctggatttaattaaaactcctgttgggttcttcacaaatgagaacttgttcaaaggatttattgaactggtattgatttcactgaaaattttccacaccaccaccattgtttttttgaattcttggtgttgtgcttcccaccttctgtccttttcgtttgtttagagaagatgaatttttaaaaagcagataaattgctaatgagcaataatgaccttatctttaccaaaacactgaaaattaagagaggttcagtgttgaagaagcacaatatgctgcggtgtctttttctagaagtgaatggaaatcttgctcagttggcatttcaagcaggaaatgaaatgcttgctttaatggcaaagcagcgttaacatttttcctgtcgtgtagcagagagtacaagaatcatttcagcaaagcagtgactcaccatgagacgttatctccatggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaatttttttaaagaaatgactttaaaaactatcatttctgtattttaattacatctcttagaaataaaattatgtttgcaccatagctttctaagaaaaaaaaatgtgtttttaactgagtcttagttgcttagtgcttttatttgtgttatttttagactgtattttaaccacaactacaaggatcatgtttcattgcacttacttatttgccagtgtctgcctgtctttgctaaatacattactatctccaaattgcctaaaatctgctatgattctacagtaaatagctcagggtatttctatttatcactactaaaagggcaccatagtatgttttggtactttaggcagtaaacactgcttggtttatcattttgttattaaattagaacaagaacatcaaatggatttgctgcactagttattctttgtactgttgagcaacttggtgtgcttatatgttgtgttggttgaagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgttggaa

SEQ ID NO: 107721 - DNA, 3686 bp, Homo sapiens
  Payload ID: 1148
  Gene Symbol: ANKRD44
  Gene Name: ankyrin repeat domain 44
  Uniprot ID: Q8N8A2
  ENST ID: ENST00000328737
  CDS Start-End: 78-2837
ttcagaggctgcgtctttcaggaggccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttggccaaaggggcaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacgtaagtgtaactactaaagttggacttgaacccagggtcatagtcatttattcaataagtattaagagcctgctgtgtgccagactagctctggggagcacagtggtgaaagatgcagtcctggcttcccctgcatgaaggtgacagtcacatacctacaagtgctgaccaagctgggcagttttagttagaatccttcttttgatatgtcttcatttaattttgtgaagtctctctttttctttgctgatatttctggggtaatattataaatttagtgggctgttagaaaaattttatggactgacatatttggggaaactatttgtattatgtattagcattatgtattctgactggaaaatgacagttttgcaaatcagtttcccagaatacatttgaagagtttctaagctatttgtcttgattatattttaatataattcagtgtaacccttggtgtgaaagatctaaaagctgtttcattttccgctttaggaaattatttatgcatttgttttaaaggcaaaggaatttttttcatttaagattcttaagccgggcgtggtggctcatgcctttaatcccagcactttgggaggccgaggcagttggattacttgaggccaggagttcatgacccgcctggccaacatggtgaaaccccgtctctactaaaaatacaacaacaacaaaattagctgggcatgatggtgggtgcctgtaacctcagctacttgggaggctgaggcaggagaatcacttgaacctgggaggtggaggttgctgtgagctgagatcgtgccactgcaccactccagcctgggcaacaagagcgagactgtccccccac

SEQ ID NO: 107722 - DNA, 2724 bp, Homo sapiens
  Payload ID: 1148
  Gene Symbol: ANKRD44
  Gene Name: ankyrin repeat domain 44
  Uniprot ID: Q8N8A2
  ENST ID: ENST00000409153
  CDS Start-End: 184-1923
actagccagtgtcagcctctcggcgggaggaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttggccaaaggggcaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattggtgagttgttttgttttgttttctctaacacacacacacacacataccccaaatcacagaggcattaactgtttttttccagagttgtagctctggcttgtgtaaaaagtgggtccatgaatcaggatttcatgaattctgatttcaaaaagtgttttttctactgcaccatgctgccttccattgcaggttagagccccaccaccacccaaggcttttaagcacagcacaaaagcatggtagtcatcgatataaggcagtaccatttctgcctcctaacaccagcattgccatggaagttggtatagacctattagcaaatatggctttgtgtttagatcccatataagaaatgctcctcacaaaatgtgtatgcgtgtgtgtgtgtgtgtgtgtgtgtgtgtgtgtgtgtggtaatcagtggcagagtgaaggctttctactgtcactacatattatgagcctgccttccaaaatatacttaagacacagctgtctttaattggttttctctatgaaaaccatgtcataattgtcatgataaaacaaacttttattatacagtttgttattatagtcttaataatgtgtgctgttctatagtacttttgtgagttatctttaatccttcatagtctagaaactcaggataattatcctaacaccttctttgtatagaaataacatatcgcatgcaatatcttcattttttcaggaagaccattttggtaccattatttctgttattcaagtaagagtttttcctgtccataagaaggtttcacaaattttgtctgaaaatgaaattacccccctttgattagatcaacatttgccctgtgtaatttacaaagagatgactatttgtgacaattataaaacattcaaaaa

SEQ ID NO: 107723 - DNA, 1622 bp, Homo sapiens
  Payload ID: 1148
  Gene Symbol: ANKRD44
  Gene Name: ankyrin repeat domain 44
  Uniprot ID: Q8N8A2
  ENST ID: ENST00000409919
  CDS Start-End: 184-1287
actagccagtgtcagcctctcggcgggaggaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggagatggtcaatttactcttggccaaaggggcaaatatcaatgcatttgacaagaaggaccggcgtgctctgcactgggcagcatacatgggccacttggatgttgtagcattgctcattaaccatggcgcagaagtgacctgtaaggataagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtaggttaccgcaaaaatacggtggaataattgcctcaagtgggaatactgccaaaaagattcttccgtgcagtagatagttcccatttatccaggttaaggtggatctataccattatactaaatacaaattaaattttaaataaattaagtgccttttaatgacagaggcaaagaagaaccaattttattttttagcttcatccaaatgaggtctatttcagtggttttaattaaggaaacttgaactttattcgtaacttttctttctaatattcttctgtccttcccaatgcttcatattaaacaggaaaaataaaacctaactgagccaattta

SEQ ID NO: 107724 - DNA, 326 bp, Homo sapiens
  Payload ID: 1148
  Gene Symbol: ANKRD44
  Gene Name: ankyrin repeat domain 44
  ENST ID: ENST00000443014
  CDS Start-End: 98-326
ttaggggaagggggcgtaaccccatctccccggttaaagtggacggcatccaccattggttcaggcaatcttcagcggtgatccagaggagatccggatgctcatccataaaactgaagatgtgaatactctggattctgagaaacgaacccctcttcatgtggccgcatttctgggagatgcagagatcattgaactcctgattttgtcaggagctcgtgtaaatgccaaggacaacatgtggctgactccactgcaccgggctgttgcttccagaagtgaagaagcagtacaggttttgattaagcactcagctgatgtcaatg

SEQ ID NO: 107725 - DNA, 2798 bp, Homo sapiens
  Payload ID: 1148
  Gene Symbol: ANKRD44
  Gene Name: ankyrin repeat domain 44
  ENST ID: ENST00000424317
  CDS Start-End: 1-2376
aagaagggttatacccctctgcatgctgcagcctccaatggacagattaatgttgtcaagcatctcctgaacctgggggtggagattgatgaaatcaatgtctatggaaatacagcgcttcacatcgcctgctacaatggacaggatgctgtggttaacgagttgattgactacggtgctaacgtgaaccagccaaacaataatgggttcacccctttgcattttgctgctgcctccactcatggtgctttgtgtcttgaattgttagtaaacaacggggcagatgttaacattcagagtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggacaaaagtatagcatagtatccttgtttagtaatgagcacgtgctgtctgcaggctttgaaatagacaccccagataaatttggaagaacgtgccttcatgctgctgctgcaggaggtaatgtggaatgtataaaactcttgcagagcagcggagcagatttccataaaaaggacaagtgtgggaggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcagtaattaatggtcacacactgtgtttacggctgttgctagaaattgcagacaacccggaggcggtcgatgtgaaagatgccaaaggacaaacaccactgatgcttgcagtagcatatggacatattgacgctgtttcattgttacttgaaaaggaagccaacgtagacactgttgacatcctaggatgcacagctttacacagagggattatgacaggacacgaggaatgtgtgcaaatgctgctggaacaagaagtgtcaattctctgtaaagattccagagggaggacgcccttgcactatgcagctgctcgtggccacgccacgtggctgagcgagctgctccaaatggctctttctgaggaggactgttgtttcaaagataaccaaggctacacgccgctgcactgggcttgttacaatggtaatgaaaactgtatagaggtacttttggagcaaaaatgttttcgcaaatttatcggtaatccctttactccactgcactgtgcaataatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatggctgttaaccattcaagatccaagaacatcggttggctgcaaaacaggcaccctgagggaccaattatgaatcagaatgcactttatcccagccacagaacgcaaagggttacactctgcaggagctgcggttggggaagggaaagggagtaaccggattcgccttgcctgtctgtgattgggaagcacgcaccctttattttccaactgggaacaagatactggaaattcctctttcccttagaaaacagaaggcaagggtgttggctgtggaaattagaactgggtaatatttctagagcactttgaaattctttcaggataagtgttatacgaacacaaatgatttctttcattgttaaattgtgttcctatcattggtaacgccccaagtaaagcctttttaattaaaaatctctggatgctataa

SEQ ID NO: 107726 - DNA, 576 bp, Homo sapiens
  Payload ID: 1148
  Gene Symbol: ANKRD44
  Gene Name: ankyrin repeat domain 44
  ENST ID: ENST00000447713
  CDS Start-End: 194-316
tgcaaaccccactagccagtgtcagcctctcggcgggaggaggcggcggcggaggaggagcagggggagggctgtcaaattcgggagccagattttttcccttctcctggcaatcccttccgcttccccggctcccggcgtgacatctgcgggccggggacctgcatgtgtgtgcgcgcgaaggagcggaagaatggcagtgctcaaactcaccgaccagccaccattggttcaggcaatcttcagcggtgatccagaggagatccggatgctcatccataaaactgaagatgtgaatactctggagctcgtgtaaatgccaaggacaacatgtggctgactccactgcaccgggctgttgcttccagaagtgaagaagcagtacaggttttgattaagcactcagctgatgtcaatgcaagggacaagaactggcagacccctcttcatgtggcagcagccaacaaggctgtcaaatgtgcagaagtgatcattcccctgctgagcagtgtcaatgtctccgaccgaggggggcgcacagccttgcaccatgcggctctgaacggccacgtggag

SEQ ID NO: 107727 - DNA, 1000 bp, Homo sapiens
  Payload ID: 1148
  Gene Symbol: ANKRD44
  Gene Name: ankyrin repeat domain 44
  ENST ID: ENST00000448801
  CDS Start-End: 1-547
aatcaatgatcatgggaattgtgcatcattgctgcttggggccatagattccagtatcgtcagttgtagagatgacaaaggcaggacaccccttcatgcggcagcatttgctgatcatgtggagtgcttgcagcttcttctgagacacagtgctccagtgaacgcagtagataattcagggaaaacagcactgatgatggctgctgagaatgggcaggcaggcgctgtggatattttggtgaacagtgcccaggctgatctgactgtaaaggataaggacttgaatacacccttacatttggcttgtagtaaaggtcatgaaaaatgtgccttgttaatacttgacaagatacaagacgagagccttattaatgaaaaaaataatgcactgcagacacccctccacgtcgctgcgcgcaatggcttaaaggtggtagttgaggagttgctggccaaaggggcctgtgtacttgctgtagatgaaaatgcttctaggtcaaatggaccccgttccacacctggaaccgctgtacaaaaagaagaatgagactctttaaaaattatgcacatacacatgcacacatatatgtgtgcgtgtgtatatatatatatatgtgtgtgtgtgtgtagttcatcagccagctacacatgaggaccaaaatgcttcagtctaaaatggaagatacacatttttttccttcaaaatgcaagtgagaactgaagtagcttttttatggagttaaatgtaatctttctgtgtaccagtctttgttgtattttatatttcttaggacacagatttctagttgaccacttaacatttgtaactgatgatgtgctgacctttttttttttttttgccaaactagagaaaatgtccatatacttttgctgtaaatgtgtttatatttatttgaaatgaaacaaatggtgaggaaacatccattatttgttctctattttaattgctatgtatcttatttagaataacaaaaaaaaa

SEQ ID NO: 107728 - DNA, 949 bp, Homo sapiens
  Payload ID: 1148
  Gene Symbol: ANKRD44
  Gene Name: ankyrin repeat domain 44
  ENST ID: ENST00000422886
  CDS Start-End: 1-949
agtaaagatggcaaaagtccactgcacatgacagctgtccatggaaggttcacacggtcacagaccctcattcagaatggaggtgaaattgactgtgtggataaggacggcaacactcctctccatgtggctgcaagatacggtcatgagcttttgattaacaccttaataaccagcggagctgacacagccaagtgtggaatccatagcatgttccctttacatttagctgccctaaatgctcactctgactgctgcagaaagttgttatcatcgggctttgaaatagacaccccagataaatttggaagaacgtgccttcatgctgctgctgcaggagggacccctttgcactatgcagctgcgaattgtcatttccactgtattgagacattagtgaccacaggggccaacgttaatgaaacagatgactggggacgcacagctttgcattacgccgctgcatcagacatggatagaaataagactatcttaggaaatgcccatgataattcagaagaacttgaaagagccagggagctgaaggaaaaggaagccacactatgtctagagtttctgcttcaaaatgatgcaaatccatctatccgggacaaggaaggttacaatagcatacattatgctgccgcctatgggcacaggcagtgtctggaattgcttttggaaagaacaaacagtggatttgaagaatcagattctggtgctactaagagtccactccacttagctgcctacaatgggcaccatcaagccttggaagtccttctgcagtcgttggtggacctggacatcagggatgagaaaggccgcactgctctggatctggctgcctttaaaggacacacagaatgtgtggaagcgcttatcaatcagggcgcatccatctttgtgaaagacaatgtaaccaaaagaaccccacttcatgcctcag

SEQ ID NO: 107729 - DNA, 1446 bp, Homo sapiens
  Payload ID: 1149
  Gene Symbol: ANKRD45
  Gene Name: ankyrin repeat domain 45
  Uniprot ID: Q5TZF3
  ENST ID: ENST00000333279
  CDS Start-End: 62-862
gttgcgccgttgctatggtaaccgaggaggccggggcccgggtgtggtatttttggagttaatggagtcagaaggacctccagagtcagagagttcagaatttttctcacagcaagaagaggaaaatgaagaagaagaagcccaagaaccagaggaaacaggccctaagaacccccttttacaacctgctctcacaggggatgtagagggtttgcagaagatatttgaggatcctgagaatcctcatcatgaacaggccatgcagcttctcttagaagaagacatcgttgggagaaatttgttgtatgcagcttgcatggctgggcaaagtgacgtgattagagctttggcaaaatatggtgtgaatctgaatgaaaaaaccaccagagggtacacactcttacattgtgctgcagcctggggtcgtttggaaactttgaaagcactggtagaactggatgttgatatagaagctttgaacttccgggaagaaagggctcgagatgttgctgctagatattctcagactgagtgtgttgaattcctggactgggcagatgcaaggctgactctgaaaaaatatattgcaaaagtctctttagctgttactgacacagaaaagggatcagggaaactccttaaggaagacaagaataccatcctcagtgcatgccgtgcaaaaaatgagtggttggaaacccatacagaagcttccattaatgagctttttgagcagagacaacaactggaagatattgtgactcctatcttcacaaaaatgactacaccatgtcaagtgaaaagtgccaaatctgtaacaagccatgaccagaagagaagtcaagatgatacctccaactgaacatacgttctgtaaaaggccacattttcttttagtatctgaaaggcaaacctattcatgccatttgaaatcgagaaaacagatgtgggtttctttaagtatttaagtacaacattacatcgcccttgttttgtttgacctgttcagcatgcttatgtccggactctggcctcgcctctgctcctccaagcacagccccatgtgagtttcacgtgctccttcaggaaagcacttgggtataaatcattcgtgaagaccatgtggaggctttaagaactactcagagaatctaataattttctgtgtaattgaggcattccatataaaaggacatatttggctatttccagagaaaaaatttgttctccctgcctaaaaaggaaatcttatggaatgacacttggagcaaggaaatattaagaccagcttggattaggagcctctgggtacaactatcactttttatgtccaaaattaaatttcacctgtgaggtggggtatacctctgagtaaaacccctctttatctttgacctccttctatctgtaaattaataaacacaaatctgtatagttttatactta

SEQ ID NO: 107730 - DNA, 2649 bp, Homo sapiens
  Payload ID: 1150
  Gene Symbol: ANKRD46
  Gene Name: ankyrin repeat domain 46
  Uniprot ID: Q86W74
  ENST ID: ENST00000335659
  CDS Start-End: 180-866
accgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaa

SEQ ID NO: 107731 - DNA, 661 bp, Homo sapiens
  Payload ID: 1150
  Gene Symbol: ANKRD46
  Gene Name: ankyrin repeat domain 46
  ENST ID: ENST00000358990
  CDS Start-End: 77-661
accgcctccttgaagctgccgctgtcgctgctgctcgttcgagtcgcaggcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagta

SEQ ID NO: 107732 - DNA, 3270 bp, Homo sapiens
  Payload ID: 1150
  Gene Symbol: ANKRD46
  Gene Name: ankyrin repeat domain 46
  Uniprot ID: Q86W74
  ENST ID: ENST00000520311
  CDS Start-End: 805-1491
ggtacttggcccggggcctgtgggcagcgcctgggctagagccacttgatatctcctgcaccgtccctgtagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatccc

SEQ ID NO: 107733 - DNA, 1686 bp, Homo sapiens
  Payload ID: 1150
  Gene Symbol: ANKRD46
  Gene Name: ankyrin repeat domain 46
  Uniprot ID: Q86W74
  ENST ID: ENST00000520552
  CDS Start-End: 163-861
gccgctgtcgctgctgctcgttcgagtcgcagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatagaaggacactgaggcttggaagctttgcaaggcaagacagaagccgaatccaggccatctaatctctaggtcagtgtcctgtgctcctgagcctcagaaggcaagaaagaagggatacagacgtcagcgtccctgttgggtggggctgtttccgtcacgacttgtgtcatggagcatcatctcaaagctctgcagttaggaggcagagggacctgctaccacctgtcccctcctctccagtcctgccctgcaggcagcccgggcacctgctgtcttcctggcctcccagatcctcaagatggagctccaggaaccatcccctcctccgcccgggcaggatgccacctccacaaggcaaatcacatccatttgatcttgaacaaaaggctgccgtggtgtctgaaatgacaactcccaggcgggtgatgtcatgctgttttgtttgtctccatggactgtggggatccaatttcagttgtgaagaaaacggtctggggaaaaaagttacttcattcggaaaattccgagaagccataaatacagtttgcagctgaggaaagcactttcacactcagacaatggatttgggtggaagaaaagacttcccgcccctaaggctgagccccttcactcccacccatggccaccggcagcccgcttctgccagcagatagatgtgtgcatggctctggcaagatctcaagcaaccccccttccccaaggagactctccgtgacccagtggcaagttggcaggggatgtgttttccctggttctcatcctaaattgtctcctgcccagagtccatccctgaagtatcaggcacttccctctcgtaaatggttgacctgcatctctgagctgctgttaaagcaaatttaaaataa

SEQ ID NO: 107734 - DNA, 592 bp, Homo sapiens
  Payload ID: 1150
  Gene Symbol: ANKRD46
  Gene Name: ankyrin repeat domain 46
  ENST ID: ENST00000521345
  CDS Start-End: 346-592
agctgccgctgtcgctgctgctcgttcgagtcgcaggtacttggcccggggcctgtgggcagcgcctgggctagagccacttgatatctcctgcaccgtccctgtagcactggaggtccagtaggcctggccggggccctgaggggcgagggtgcccgggcttcccacaccttccgcggcgactggagggagccgggccgaggaagcgaccgcggatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttc

SEQ ID NO: 107735 - DNA, 2779 bp, Homo sapiens
  Payload ID: 1150
  Gene Symbol: ANKRD46
  Gene Name: ankyrin repeat domain 46
  Uniprot ID: Q86W74
  ENST ID: ENST00000519597
  CDS Start-End: 310-996
gtctggcccctcccctccgcccgtcaccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcctcactttgatgcccaggctggagtgctgtggctcaatcacagctcatcgcaacctcgacctcccgggctcaagtgatcctctcacctcagcgtcccgaacaggcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaa

SEQ ID NO: 107736 - DNA, 580 bp, Homo sapiens
  Payload ID: 1150
  Gene Symbol: ANKRD46
  Gene Name: ankyrin repeat domain 46
  ENST ID: ENST00000524072
  CDS Start-End: 272-580
tgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcgggggatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatt

SEQ ID NO: 107737 - DNA, 567 bp, Homo sapiens
  Payload ID: 1150
  Gene Symbol: ANKRD46
  Gene Name: ankyrin repeat domain 46
  ENST ID: ENST00000523000
  CDS Start-End: 311-567
cttgaagctgccgctgtcgctgctgctcgttcgagtcgcagggttttgctctgttgctcaggctggagtgcagtggcacaatcatggctgaatgcaccctccacctcccaggctcgagtgatcctcctgcctcagccttgaatatctgggacaacaggcacgcacgcaccaccatgcaagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtgg

SEQ ID NO: 107738 - DNA, 713 bp, Homo sapiens
  Payload ID: 1150
  Gene Symbol: ANKRD46
  Gene Name: ankyrin repeat domain 46
  ENST ID: ENST00000519316
  CDS Start-End: 145-672
tctatttactgtagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcct

SEQ ID NO: 107739 - DNA, 1844 bp, Homo sapiens
  Payload ID: 1151
  Gene Symbol: ANKRD49
  Gene Name: ankyrin repeat domain 49
  Uniprot ID: Q8WVL7
  ENST ID: ENST00000302755
  CDS Start-End: 95-814
tcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagta

SEQ ID NO: 107740 - DNA, 573 bp, Homo sapiens
  Payload ID: 1151
  Gene Symbol: ANKRD49
  Gene Name: ankyrin repeat domain 49
  ENST ID: ENST00000540349
  CDS Start-End: 148-525
aggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatcttaccacagtgcggagactcctttctgaaaaggccactcac

SEQ ID NO: 107741 - DNA, 567 bp, Homo sapiens
  Payload ID: 1151
  Gene Symbol: ANKRD49
  Gene Name: ankyrin repeat domain 49
  ENST ID: ENST00000541144
  CDS Start-End: 233-567
ctgtcaggtgggttgttattccctgtcccggacctcgctttttgatggaccggcgccatctaagaactcctgagcccgtgggggtgggtagcctgtggacacaggccgagccctgcaggtcaggccgcttcgtggtccccagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactg

SEQ ID NO: 107742 - DNA, 2268 bp, Homo sapiens
  Payload ID: 1151
  Gene Symbol: ANKRD49
  Gene Name: ankyrin repeat domain 49
  Uniprot ID: Q8WVL7
  ENST ID: ENST00000544612
  CDS Start-End: 498-1217
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacacaaaa

SEQ ID NO: 107743 - DNA, 562 bp, Homo sapiens
  Payload ID: 1151
  Gene Symbol: ANKRD49
  Gene Name: ankyrin repeat domain 49
  ENST ID: ENST00000545130
  CDS Start-End: 123-562
agatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattcttaccacagtgcggagactcctttctgaaaaggccactcacgtgaacactagggatgaagatgagtatacccctct

SEQ ID NO: 107744 - DNA, 515 bp, Homo sapiens
  Payload ID: 1151
  Gene Symbol: ANKRD49
  Gene Name: ankyrin repeat domain 49
  ENST ID: ENST00000535502
  CDS Start-End: 124-515
gagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaa

SEQ ID NO: 107745 - DNA, 760 bp, Homo sapiens
  Payload ID: 1151
  Gene Symbol: ANKRD49
  Gene Name: ankyrin repeat domain 49
  ENST ID: ENST00000534911
  CDS Start-End: 143-520
aggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctagcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagt

SEQ ID NO: 107746 - DNA, 587 bp, Homo sapiens
  Payload ID: 1151
  Gene Symbol: ANKRD49
  Gene Name: ankyrin repeat domain 49
  ENST ID: ENST00000544514
  CDS Start-End: 123-383
agatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggtagtcctctcctccccaaaaagagatcttaaattattttcattttaaagtcatctactaacaacttaccacagtgcggagactcctttctgaaaaggccactcacgtgaacactagggatgaagatgagtatacccctcttcatcgagcagcctacagtggacacttagatattgttcaggagctcattgcacagggggccgatgtt

SEQ ID NO: 107747 - DNA, 3002 bp, Homo sapiens
  Payload ID: 1151
  Gene Symbol: ANKRD49
  Gene Name: ankyrin repeat domain 49
  ENST ID: ENST00000544253
  CDS Start-End: 119-496
gcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctaggtattatttgggggtttaaggataattatctataaagatagcaagcaatcatctatattttaaaatcatttatataaagtcattaggatcatttaggaaagagaggatggaaactaacatttattaaaaactaactataccaggtaccttattacattattttatttaatcatcatgtatccctataagtaatattcttctcttttatagagtaagaaattgagattcaggaatattaatttgcccaggatcatcgaagtggaatgaacatcaaaagcctattccctctgcttggccacttccacctcattttactaagtttccccatgtctgtgttagtaaactaataactaaaagggtctcgcattttaaatagctttttaacccaagagcatgccacatttaaccagaggcccatagaacaaactgaaaattacaacctaaaaggttgtttctaaggttgtattgagaaggaattgagctcttgaatccctagaattccttattaatactttattcttctgttaaaagttttatttttaaaagtttcatacagtgtgtatattggtgtgataatcctacagaaaaatcaagcagttatgttttcttcacagataacacataaaatattaaacagaaagcctatgttattcattggactgaagcttttatgcaataaaccttagttggaccaggagtaaatgtatggtttgatattcagagaatctcattcttagaagcaacaaagtgtagttaacactaacttgttcattcttaaatcagtagtcctctcctccccaaaaagagatcttaaattattttcattttaaagtcatctactaacaagtaagtttttattcaacttaattaaatctaacaccacaagacaattttgttttagttattgttttggtttgagttgagttgaaagatttcttttttttcttctcagcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaac

SEQ ID NO: 107748 - DNA, 4212 bp, Homo sapiens
  Payload ID: 1152
  Gene Symbol: ANKRD50
  Gene Name: ankyrin repeat domain 50
  Uniprot ID: Q9ULJ7
  ENST ID: ENST00000515641
  CDS Start-End: 301-4053
agttactgccctgacggcggcggcggcggcggttggccggtgggggctggggcgagcacgaccgattctgctgggaaagctggaactggcagccgccgggggccaagaggaggatccggagctgggagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgaggtgtgttctactccctcttctgggaatgaagcctccccagcaaagcctatacctgcttgttgattctgttgatgaagggtgtaacattactgaaggtgaacaaacgtctaccagcttatctgggactgttgcagcacttttagctggtcaccatgagttctttccaccatggctattgcttctctgttctgcccgaaagcagagtaaggctgttactaaaatgtttactggttttcgaaaaataagtttagatgaccttcggaaggcatatatcgtcaaggatgttcagcagtacattcttcatcgtttagatcaagaagaagctttgcgacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagt

SEQ ID NO: 107749 - DNA, 8794 bp, Homo sapiens
  Payload ID: 1152
  Gene Symbol: ANKRD50
  Gene Name: ankyrin repeat domain 50
  Uniprot ID: Q9ULJ7
  ENST ID: ENST00000504087
  CDS Start-End: 1039-5328
agttactgccctgacggcggcggcggcggcggttggccggtgggggctggggcgagcacgaccgattctgctgggaaagctggaactggcagccgccgggggccaagaggaggatccggagctgggagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgagttacttgtggaaattgttgattacccggacgtcttaaaaccaagaaacctgtgaacaggttcattaagaatctgctgtcttgaaaaatgcatattatgaatgctttgaattaagaaggtgttaacagtggttgtcatttctgccacataagagactataatctgaaacagttcctggcagttgcccagatgcctgaaactggcacgatctagtactcttgagtgatcatccttcaacgagaaatacagagctacttacatactgtacctcataccgtataaatgtaatctctctgatgccatttaatgcagtggacctcttttcagaatctaattgtcagatgcagaattaacacttggaatctggagaagcattttgtacaaattgaaagattgggttttttctttagttttccacatgtattgtctcatctctgttcttgaaacatccacaatcacataaactccagttataaccatggagttatgtgactcattaaaatttaggaaaagtgttgctgagctgtggaatcaggcgtttctccctcagttcaacaactaatacatagactgctgatcaagaataaggaaccaaataaagtcatgcacgttctgttgacagaggaactctgtggctgttgaattttactgtaactagttactctgtcttcagagtcaacttaatatacaagttatgtcataatggatggaaagacctgtgttgatgtatccagactctagcaaatgaagataaaaaacccgttatgactaatccttgggaagagaaagtctgcaaaatggctcaaaccagtttactgcaagggaagcagttttactgtagggagtgggttttccacaagcttcagcattgcctccaggagaaaagtaactgctgcaatagtgctgtcaatgcaccatcacttgtaatgaattctgggaataatgctagtggtgtctctggaaagggagctgcctggggtgtgttgttggtaggagggcctggcagtggcaagacggccctatgtactgaactcttatggccaagttcacctgcaagtttgcagagaggtttacatcgccaagctttggcctttcatttctgcaaagcccaggactctgatactttgtgtgttggagggtttattagaggtctagtagcccagatctgccgcagtggactactccaaggatatgaggacaagctaagggatccagcagtccaaagcctcttacagcctggggagtgcgagagaaacccagccgaagcatttaaaaggtgtgttctactccctcttctgggaatgaagcctccccagcaaagcctatacctgcttgttgattctgttgatgaagggtgtaacattactgaaggtgaacaaacgtctaccagcttatctgggactgttgcagcacttttagctggtcaccatgagttctttccaccatggctattgcttctctgttctgcccgaaagcagagtaaggctgttactaaaatgtttactggttttcgaaaaataagtttagatgaccttcggaaggcatatatcgtcaaggatgttcagcagtacattcttcatcgtttagatcaagaagaagctttgcgacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcag

SEQ ID NO: 107750 - DNA, 8688 bp, Homo sapiens
  Payload ID: 1153
  Gene Symbol: ANKRD52
  Gene Name: ankyrin repeat domain 52
  Uniprot ID: Q8NB46
  ENST ID: ENST00000267116
  CDS Start-End: 123-3353
aggcggggccgcgctctccctgcagccgccaccgcagccgccgcctgggccgctccgtgtccccggtggagccgccgccgccgccgccgggagctcgatgcggacggagcccgggccgagccatggggatcctcagcatcacggaccagccgcccctggtccaggccatctttagccgagatgtggaggaagtgcgttccctactctcgcagaaggagaacatcaatgtgctggaccaagagaggcgaactccattgcatgctgctgcctacgtaggcgatgtccccatcctccagttgctactgatgtcaggtgctaatgtcaatgctaaggacacactgtggctgacccctcttcatcgtgctgctgcctcccgaaacgagaaggtgctggggctgctgctggcacattcagcagatgtgaatgcccgggacaagctgtggcagacaccactgcatgtggctgctgccaaccgggccaccaagtgtgctgaggctctggcacccctgttgagcagcctcaacgtggctgacaggagcgggcgcagtgctctgcaccatgcagtgcatagtgggcatcttgagacggtgaacctgctcctcaacaagggagccagcctgaatgtctgtgacaaaaaggagcggcagcctctgcattgggcagcttttctagggcacttggaggtcctaaaactgctggtggcacggggagcagacctcggctgcaaggaccgcaagggctatgggctgctccatacagctgctgccagtggccagattgaagtggtgaagtacctgcttcggatgggagcggagatcgatgaacccaatgcttttggaaacacagctttgcacatcgcctgctacctgggccaggatgctgtggctattgagctggtgaatgccggagccaatgtcaaccagccgaatgacaagggcttcacgccactgcatgtggctgcagtctccaccaatggcgctctctgcttggagctactggttaataatggggctgacgtcaactaccagagcaaagaagggaaaagtcctctgcacatggctgcaatccatggccgtttcacacgctcccagatcctcatccagaatggcagcgagattgattgtgccgacaaatttgggaacacgccactgcatgtggctgctcgatatggacacgagctgctcatcagcaccctcatgaccaatggcgcagataccgcccggcgtggcatccatgacatgttccccctgcacttagctgttctctttggattctctgactgttgtcgtaagcttctttcctcaggtcagttgtacagcattgtgtcttcactcagcaatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgcactatgcagctgctaacggtagctaccagtgtgcagtaacattggtgactgctggggcaggtgtcaacgaggccgactgtaaaggctgctctcccctccactacgctgccgcttctgacacttacaggagagcggaaccccatacaccttccagccatgatgccgaagaggacgagccactgaaggagtcccgcaggaaggaggccttcttctgtctggagttcttactggataacggtgcagacccctccctgcgggacaggcagggctacacagctgtgcactatgcagccgcctatggcaacagacagaacctcgaactgctcttagaaatgtcctttaactgcctggaggatgtggagagcaccattccagtcagccctttgcacttagctgcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctgctgcctctggccacactgactccctgcacttgctgatcgacagtggggaacgagctgacatcacagatgtcatggatgcctatggacagaccccactgatgctggccatcatgaatggccatgtggactgtgtacatctgctgctagagaaaggatccacagctgatgctgctgacctccggggccgcactgccctccaccgcggggcagtgactggctgtgaggactgcctggctgccctgctggaccacgacgcatttgtgctgtgccgagactttaagggccgcacgcccattcacctggcctcagcctgtggccacactgcagtactgcggaccctgctgcaggctgccctttccacagatcccctggatgccggggtggattacagcggatactcgcccatgcactgggcctcctacactggacatgaagattgtctggagttgttacttgaacacagcccgttttcgtacctggaaggaaaccccttcactcctttgcactgtgcagtgattaataaccaagacagcaccacagagatgctactgggagctctgggtgccaagattgtgaacagccgagatgccaaaggacggaccccccttcacgccgctgccttcgcggacaatgtctctgggctccggatgctgctgcagcatcaagctgaggtgaacgccactgaccacactggccgcactgcgctcatgacggcggctgagaacgggcagaccgctgctgtggaatttctgctgtatcgagggaaggcagaccttactgtgttggatgagaacaagaacacggccctccacttggcttgtagcaagggccatgagaaatgtgccctcatgatcctggcagaaacccaagaccttggccttatcaatgctaccaacagtgcgctgcagatgccactccacattgctgcccggaatggtctagcttctgtggtacaggccctgctgagtcatggggccacagtgctggctgtggatgaagaaggtcacaccccagcactggcctgtgcccccaacaaagatgtggcagactgcctggccttgatcctttccaccatgaagcctttcccacccaaggacgccgtcagtcctttcagcttcagcctgctcaagaactgcagcattgcagccgccaagacggtgggtggctgcggcgccctgccccatggggcctcctgcccctacagccaggagcggcccggcgccattgggttagatggctgctactctgagtagccccctccagtgtccctcccccgccggtggcttgatatctaattctatttatttagaaaaagtctaaacatttagggcactttaaaggagaacacgactgggtggagggggcggaggggaaggaagccctggggagcagctgctcacccctttgccacaccatcttggcctggcaggggtctgggactgacagggagcaccccaggcccttggtacccccagggcgaccccttctgccaagtgtcccaaaatgattgctaaatgcctggctcccccactctttgactccatctcttggttccctctttctgctgccagctcccccgactcttccctggggactcctctctgtgtcccccttctcccctgcccctactgccaggcagatcccctcttcttccatacccatcactgcctccctgctcggccggtccctccatccccgcagcagtgagaagccttaatttctggtactgtgtgagcactctgggggtgtccccctccccccttcaggggcagctagaggatgaggggggaggatatttagcactggggcctggagctttttccccacttctgtaccctatcacccctaaagttcaaatgcaaaacacttgaagcagcaactactgtacctgggccccaatcctgcactctcccctggctcctcatatgcaaatcaagggctggttctgcccccacagcctgccccctccccattccctcccactcctagcctggcccctaaccacgcactttaaccttgcttctttcttttatcttcttttgggagggcagagcctgtggtcattcctgccctggctctccttcccttgaactttgaggcttgtcatgaatttttaagtaagcgttttatcctttaggggaagaaacaaattaatttcctgcccatttcaaaaccacagccctagtatgtccactgtgtttcaggcatgtgtttgcatgtatatggagggagggaccatgttcttcctcctgtgccgccaagcccatagtttatctgtgctccctatctgcctccaccttccgttatgtccaagagtacccactgccccagtcactcctgatctgaagccaaagatggtaggaggggcagggccgacaagggaccgtggctactcgggacccaggcttcccctccagtgtgaggaagaagctctgacctagagagagatgaataggtactggggcttggtccctgccttcccagcagggaggaaagatgggattgagctgggggctgcactgataagatttctaaagtcgcaccccaaaagccaaactgggctggagtgaagagggggcagttttctctctaaatgtagcattgaatttggccctggtccctttaagtgctctgtccacccatctcctagtgcagcctcctggacagttggacccactcctgcagcccagtgttcccttcctcacactcaatacctcagccaggggccaagacacagaacttgaatagaggtcatgccccctccgcccccacactgcatccttgcccagtttggctgccatcagtattgtcccctgagaactggacaggcttcgtttacacagtacagggtctcccctgaggggggatccttcagcctccctcccctactcaagtttgctttattcacagtcttacccatcttttagttgtataccctgaatgtcttgccacccttgtcaagggtgggctgaggggaggggggcgtcccagggaccccctccctccccaacggatacctttaaccatacctcatgctggtttccagaagcctggggtgttgtccaagtccttatcttttcatggtcccttttgatcccctgtctctctgtgttttgcttctcccaaccctcagttcctaaatcatttcaaggcttccaaatgaccattattgatgagaaggattgtgcagcttttagtttttatttttattttcaaagccaaagggccttgtgacgcccctcttgcccacctccctccacaccgtgtcctcccctatatgacaatcaatgtgacctctcttaagggctgcagcccccatccccaaccctgctggctctgcaaagcttgccttcccttcaattctctctcctgaaatcttcccattccaccccctccctctcatcttggtgctgggaattaggtggtggggggcaaggggagtgagaagatgggtcctccagagagaacttgccgggtgtgagtcgtgttctcctttcgtgatgtttggtgatggcgggaagcgtctgagtgtcagagccccgttgtcttgctagatgagatttctgggggctgtctgcgccctgctgccctcagcgcactgtcagcagtgctgggaggtggtggggagtcctctgtccctccatatgtggctgtgaggaagcctgggggacaagcagcctcctctccttatgccaaaggaaaccccacgccccaccctgggctccccagccctagtgttttttgaagcattttgaccattctcatggccactgcatatttattttaatgttaagattttttttaaacctctttgacttaaacgggtgtggagaagtaaaacaggcagaatgccccccagtcttcatgggggagggcggggagggaacagcgccttccctttgccctccccctcccccctctccccaccgcagccctaaagcacttgcttcaagtaataagcacttttgtgaaaaggcctattttaagcgaggaccctgggagcagccccaggtcccagcaaaggaaacagagcgagggcgacataggagacagggaaacagacgtgtgaatcagagggtgagatggaaagagccagtttttagtttctgattttgggggagctatttctgattgggcggtggctctggtagggtcatatactatccttcagaaaaacgaatggcacaaaccgtgggtcccaggaaggaccagcagacccgggtcactgccactgtccactgagactgacgggccacctcccctgccccgtggccccctgagccataggactgctgaaaaccactgaatgtacagcccaggttggggtggggagcagcccctgggggagggggcttctccttttgtttggtgctgtggggcgtgggagagaaaagactgagggactgccaccccacgtagatgtgtttcttggggtggaggggctgaggagggcctacctccctctccaaccccagccatggcccctcttccttcctcacccctatccgttttgactgtaagtccagctcacctttgccttcaatatgtaaccaaaggaaaactcaatactgtttccaccactgtctgcccacccgagcaccttcttactccctggacctagaaggggagaagaggctggaggtggggtggatggggccagagtgaacggttctacagctgtatccccagaacctcctccagggtcttggaaggagtcctgagaggtgggattggggccgggctggcagggctgagtttgcgcactgtgtatcttatgcacatgagtgtttttgtctaaatgactccagtgactgctccagcggggaggccccttcctccttccctctcagccatttctcacccacttcccatacccagtgttcatcccctacctccccttcccaccgcaaaggaaaatagccttacagaccctagcccagaaaccctactcctggggcaaaccagtatgggcccccatcccgcctagtttgaaccctaccttttaagaaggagggataaggaacaaagcagccccttcccctctaattgtggtggctccagccttctgcagccttgacccaggttgggcaagggcggaggtgaggaatctttgaggaccaagcccagtggtctgggaatcgggaggtagagagggaagggtctgccttgggggctccctcctcccaacccaacccctagagaagcgaccaaatcccagagatggggtgaagctggggtggggagggtctgctctttgaattacttgaaggtactgactccaaggctgctgttgcccacttaggtgtgagggggacactgtcactgcatttgggagggcagagggtggcgggtaaccagaggatccaccttggccctcacccactcctgctaggccctttccctggggaatctggaagcctgactttgcccccagggaagttggggaccgccttccctcccttctccacctctcactctgggcaccctctccaattgcactaaagtagctgttgtgccagtctgccccccacaaggggggaggtctctgcttccagtcttcttcccccgctgcctccgctcccaccctggacaatctccttgtttcccttgtgttcctggatagctcagctttgtatgtgtgtttggggggtgggggtgggttctggcttgagtgggtttggcaggggtttgggaagggttaggggaggatggaggatgaagtctcctacccccttctccagctccaggccacagaagcctgggaagggagggtgcctactctcgctgctgtgtgtcttgcagatgtgccaaaatgggggtgggtgggaggggagggtgcctggcagagcagcccctggggtggctctctcaaagcaatatagttcccctgcgggggacagcaagacaggggagagggttggggtggggacctgggggttccccatgtacagctatgtatattcaggggtgttctccgtctggtacccgctgtgggcatctatgtgtgtgtgaacctccccttccccatgccctgcatgacctgtgatgctgcagacaccaccatcctgtgtgcaggtgtgtgttggggggcacggaggggcatgttccatgtcctgttgcaccctccaccctgtgacccatgtactcggttgtaggaagtaaagagaactgagcacaattcactggattctagtggaatctttctctaagcaattttcccattcctgcctctccctgccccggaaccacctgtggtgctagtgttgggatcgggggcgtttaacgctggtgggcagcaataaggggcagatgtgcccagatgcctgcatccccagggtgccgagggcagcaggaaaaagtggggacctcggtgcatttgccccacccctcccctccctgggctaaagcacaatgttctccccgcagattaatgaccctgcaccctccaggcccctactcacatcctcccccaaccggcttcgggtcctcccaccacactctggttttctatgctgttttggtgcaagtacaactgtcgtagtcatggctttgggatgggttctgtttattaaaatcctattgctccta

SEQ ID NO: 107751 - DNA, 2185 bp, Homo sapiens
  Payload ID: 1154
  Gene Symbol: ANKRD53
  Gene Name: ankyrin repeat domain 53
  Uniprot ID: Q8N9V6
  ENST ID: ENST00000272421
  CDS Start-End: 267-1298
ctgagtttcccgggcagcaggactgggaggttgagtgggggttttggctcagaccgggagcagagcggcgggtggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccagaccccaggcctcccttttctctgcaaataaatctcttggcaccccccca

SEQ ID NO: 107752 - DNA, 1666 bp, Homo sapiens
  Payload ID: 1154
  Gene Symbol: ANKRD53
  Gene Name: ankyrin repeat domain 53
  Uniprot ID: Q8N9V6
  ENST ID: ENST00000360589
  CDS Start-End: 35-1627
cccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtg

SEQ ID NO: 107753 - DNA, 1797 bp, Homo sapiens
  Payload ID: 1154
  Gene Symbol: ANKRD53
  Gene Name: ankyrin repeat domain 53
  ENST ID: ENST00000441349
  CDS Start-End: 195-959
tggggagcggcaggcgggcagggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgcgttcttgaaggatgccatgtggaaaaaggacaagaaggactttgcccgtgagatgacgaaaatgaagatgttcaagagccagctgaccctcatggagcacaactacctgattgagtatcaaggtcaaggatgcagtgtgcacttcccatttgccttttcccccatcacaccagagactctcctatggcaggacatttctctactatcagactgtggattcctttggagaagaagggaattgtctttctaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaaggctgaagtgtggcaattcacgttgtgggtggcgaggaaagggggaggggtgcctatgggcttcccactcccaagctcgaggagtcacccttcccaatcaaaagcccag

SEQ ID NO: 107754 - DNA, 1671 bp, Homo sapiens
  Payload ID: 1154
  Gene Symbol: ANKRD53
  Gene Name: ankyrin repeat domain 53
  ENST ID: ENST00000457410
  CDS Start-End: 140-1630
ctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaaaagagcacaaaattctcagagaagctgctatcagaaagtggctccacggcaagctgcacccaggccactctctggtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacaatgtggaatgttagcaacaaccccgccagaccccccaccacccagatcagccactcgcagggcatccgcctgggcgtgcatccagaccccactccggagcacgacttcagcagcttcctggaggtgaggcctgatgggcacggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccctgccctccccacaaaccaacccataaagttattatggctacctctccccctgaggcagcccagtgaa

SEQ ID NO: 107755 - DNA, 2184 bp, Homo sapiens
  Payload ID: 1155
  Gene Symbol: ANKRD54
  Gene Name: ankyrin repeat domain 54
  Uniprot ID: Q6NXT1
  ENST ID: ENST00000215941
  CDS Start-End: 194-1096
ggtttaagctggaagggtagtcattggttcgccgctctgtctcggcctgagcccgcccccgctcggttgccgtggttgcgggccctgcccgcccgccagctcgctgacagcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgccctcacccgcagatgccgtggggcagagatgctctctctccacggcctcagagccactcccagccacagtttccagcatctctgtggacagggaccacagctcccagcttcttccagttctcgcagcaccagaccagcctctgcagctgcacttcagctccgcagacctgcgctatctcagcagacctcacttgccccatggccttcatggcgcgctccaggcctcagacccttctctgtgttccgtcctggccatgggcttgttgcagtcagcaggtgtgggcttaggcgggcaccctgtggccaggggtactgcgtgaggccctcagttggtcctgtgcctctcaccagcacttagacagacacgtcaccagactttcaaggagatactgcagtgagtttctctggttggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacagaagagcaggtgacgggagaggaggttggaggtgtagcgatggagcaggaaactggagttgaggagggcagctcaagccacagagtccaggccacctcagagccaggaaatgcatcctcccacagagccctggaaggccccagccctgctcccacctggactggctcagtgaggctaattttataattctggctgattttagaactctaagggaataaatttgtgttgttttaagtca

SEQ ID NO: 107756 - DNA, 954 bp, Homo sapiens
  Payload ID: 1155
  Gene Symbol: ANKRD54
  Gene Name: ankyrin repeat domain 54
  ENST ID: ENST00000406423
  CDS Start-End: 294-836
ggggcggggcagcccgggcgaggggcggggcctcagaggaccagtggccgcgctttggtcgcccccgaccctcagccggggtcccccgacgtctgcgctgagggccacactgacccttgagtctcctttcagtaacgatggtgatgatggtttttttagaaagtcttcctgctctgagccagtcaccccagtcttctctcactgggtaatttctgaatggaaacttcccatgactcggaacgcttattggtgaataataaaatgagctctgaagagactgagggactcggccaatgccaatgatgtggaaacagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctgggacttggagctgcacttgtctggtgaggaccttgcc

SEQ ID NO: 107757 - DNA, 789 bp, Homo sapiens
  Payload ID: 1155
  Gene Symbol: ANKRD54
  Gene Name: ankyrin repeat domain 54
  ENST ID: ENST00000407117
  CDS Start-End: 322-789
cgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagcagctgctggaagatggcgcggatccctgtgcagctgatgacaagggccgcacagctctacactttgcctcatgcaatggcaatgaccagattgctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctcc

SEQ ID NO: 107758 - DNA, 735 bp, Homo sapiens
  Payload ID: 1155
  Gene Symbol: ANKRD54
  Gene Name: ankyrin repeat domain 54
  ENST ID: ENST00000434930
  CDS Start-End: 86-735
agcacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggagctggtacctgcaggggcccgtgtagatgccctggaccgagctggtcgcacacccc

SEQ ID NO: 107759 - DNA, 794 bp, Homo sapiens
  Payload ID: 1155
  Gene Symbol: ANKRD54
  Gene Name: ankyrin repeat domain 54
  ENST ID: ENST00000413497
  CDS Start-End: 1-536
cgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgctgctcctggaccatggtgctgatcctaaccagcgagatgggctggggaacacgccactgcacctggcggcctgcaccaaccacgttcctgtcatcaccacactgctacgaggaggtatgtggtttcttcccctctctgtcctctttctccccctcacccccagaatgctcacctcagctggtacctgcaggggcccgtgtagatgccctggaccgagctggtcgcacacccctgcacctggccaagtcaaagctgaatatcctgcaggagggccatgccc

SEQ ID NO: 107760 - DNA, 597 bp, Homo sapiens
  Payload ID: 1155
  Gene Symbol: ANKRD54
  Gene Name: ankyrin repeat domain 54
  ENST ID: ENST00000424350
  CDS Start-End: 328-597
ggggcggggcagcccgggcgaggggcggggcctcagaggaccagtggccgcgctttggtcgcccccgaccctcagccggggtcccccgacgtctgcgctgagggccacactgacccttgagtctcctttcagtaacgatggtgatgatggtttttttagaaagtcttcctgctctgagccagtcaccccagtcttctctcactgggtaatttctgaatggaaacttcccatgactcggaacgcttattggtgaataataaaatgagctctgaagagactgagggactcggccaatgccaatgatgtggaaacagcagctgctggaagatggcgcggatccctgtgcagctgatgacaagggccgcacagctctacactttgcctcatgcaatggcaatgaccagattgctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctg

SEQ ID NO: 107761 - DNA, 946 bp, Homo sapiens
  Payload ID: 1155
  Gene Symbol: ANKRD54
  Gene Name: ankyrin repeat domain 54
  ENST ID: ENST00000411961
  CDS Start-End: 84-938
cacgactcagggcggagggaagtaggtccgttggtcggtcgggaacgaggctcaggcggccaggcccgcgcggagccgttgccatggcagccgccgccggggacgcggacgacgagccgcgctcaggccactcgagctcggagggcgagtgcgcggtggcgccggagccgctgactgacgctgagggcctcttctccttcgctgacttcgggtctgcgctgggcggcggcggcgcgggcctctcgggccgggcgtccggcggggcccagtcgccgctgcgctacttgcacgtcctgtggcagcaggatgcggagccgcgcgacgagctgcgctgcaagatacccgctggccggctgaggcgcgctgccaggccccaccggcggctcgggcccacgggcaaggaggtgcacgtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggcggcctgcaccaaccacgttcctgtcatcaccacactgctacgaggaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagag

SEQ ID NO: 107762 - DNA, 623 bp, Homo sapiens
  Payload ID: 1155
  Gene Symbol: ANKRD54
  Gene Name: ankyrin repeat domain 54
  ENST ID: ENST00000458278
  CDS Start-End: 1-623
cgcgcgacgagctgcgctgcaagatacccgctggccggctgaggcgcgctgccaggccccaccggcggctcgggcccacgggcaaggaggtgcacgctctgaagagactgagggactcggccaatgccaatgatgtggaaacagtgcagcagctgctggaagatggcgcggatccctgtgcagctgatgacaagggccgcacagctctacactttgcctcatgcaatggcaatgaccagattgtgcagctgctcctggaccatggtgctgatcctaaccagcgagatgggctggggaacacgccactgcacctggaatgctcacctcagctggtacctgcaggggcccgtgtagatgccctggaccgagctggtcgcacacccctgcacctggccaagtcaaagctgaatatcctgcaggagggccatgcccagtgcctagaggctgtgcgtctggaggtgaagcagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctg

SEQ ID NO: 107763 - DNA, 825 bp, Homo sapiens
  Payload ID: 1155
  Gene Symbol: ANKRD54
  Gene Name: ankyrin repeat domain 54
  ENST ID: ENST00000609454
  CDS Start-End: 419-742
tggccatctgagacagccatatccagaaggaagaggagccgcgttccgtggctcacacctgtaaccccaccagtttgggaggccgaggcgggcggatcacctgaggctgaggccgggggtttgagaccagcctgaccaatatggagaaaccccgtctctactaaaaatacaaaattagccgggagtggtggcgcatgcctgtaattccagctactcgggaggctgaggcaggagagtcgcttgaacccgggaggcggaggttgcggtgagccgagatcgcgccattgcactctagcctgggcaacaagagggaaaactccgtctaaaaagaataagagggttacaagtagcctgaattttcctctcttcaaatagggacttctcaaagaagctctgaagagactgagggactcggccaatgccaatgatgtggaaacagtgcagctgctcctggaccatggtgctgatcctaaccagcgagatgggctggggaacacgccactgcacctggcggcctgcaccaaccacgttcctgtcatcaccacactgctacgaggagatcatccatatgctgagggagtatctggagcgcctagggcaacatgagcagcgagaacgcctggatgacctctgcacccgcctgcagatgaccagtaccaaagagcaggtggatgaagtgactgacctcctggccagcttcacctccctcagtctgcagatgcagagcatggagaagaggtagcaagagaggctccctgccttcctgccactgccccaccctgccccactgctgtctcagtaccaagaaaaagcccaacatctggg

SEQ ID NO: 107764 - DNA, 2502 bp, Homo sapiens
  Payload ID: 1156
  Gene Symbol: ANKRD55
  Gene Name: ankyrin repeat domain 55
  Uniprot ID: Q3KP44
  ENST ID: ENST00000341048
  CDS Start-End: 153-1997
acatgctctgtctggccctgtgaatcctcactcacccattcagatttctgttggtgtaaagcgacattccagctgctgaagctccgtgatctgctgtgtttttccagcccagatccaagagacctggatgctttttgccattctgatggtaaatgatgagacaggctaccatggatttcagcaccccttctgtgtttgatcagcaaagaggtgactcatctgaggaagttgacctgaccatggtttatcaagcagcctctaatggagatgtcaatgctctgactgcagtgattcgggaagacccttctatcctagaatgctgtgacagtgaaggatgcacgcccttgatgcatgcggtttctggacgtcaagcggacacagtgaagctgctgttgaagatgggagccaatattaacatgcaggatgcttatggccgcacaagtttatgcctggccacctacctgggctggcttgaaggctgtgtgagtctactcagaaacggtgccaagcacaatatcccagataaaaatggccgcctgccactgcatgctgccactgctgagcccgatatgaggctcctcacggtcctgttgcaacagtcgaacatcagcgagattaatcaccaggacaatgagggaatgacaccactccactgggcggctttccacaaccagcctcaacacacacaaatgctgctgaagaagggggcagaccccacccttgtggataaagactttaaaaccgctctccactgggcagtccagagtggaaataggattctgtgctccatcattctgagccatcaccaggggccgtccataatcaactatgatgatgagagtgggaagacatgtgtacatatcgcagcggcagcgggcttcagcgatattattcatgagctggcaagagtccctgagtgtaacctgcaggctctggatgtggatgacaggacacctctgcactgggctgcagctgcagggaaggccgaatgtgtccagtcactgctggagttgggaatggacagcaacctgcgggacatcaatgagagcacgcccttggcctatgccctgtactgcggtcacacggcgtgtgtcaaactcctctcccaagagagcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaagcaaaaaacaaaacaaaaaaaaaaccacatcccagacaaacatgtcttcacatttattgtcattctaacttgaactaatgaaacctatttaaaaataaattcctatgatcagtcacagt

SEQ ID NO: 107765 - DNA, 626 bp, Homo sapiens
  Payload ID: 1156
  Gene Symbol: ANKRD55
  Gene Name: ankyrin repeat domain 55
  ENST ID: ENST00000513241
  CDS Start-End: 84-620
attccagctgctgaagctccgtgatctgctgtgtttttccagcccagatccaaggtgactcatctgaggaagttgacctgaccatggtttatcaagcagcctctaatggagatgtcaatgctctgactgcagtgattcgggaagacccttctatcctagaatgctgtgacagtgaaggatgcacgcccttgatgcatgcggtttctggacgtcaagcggacacagtgaagctgctgttgaagatgggagccaatattaacatgcaggatgcttatggccgcacaagtttatgcctggccacctacctgggctggcttgaaggctgtgtgagtctactcagaaacggtgccaagcacaatatcccagataaaaatggccgcctgccactgcatgctgccactgctgagcccgatatgaggctcctcacggtcctgttgcaacagtcgaacatcagcgagattaatcaccaggacaatgagggaatgacaccactccactgggcggctttccacaaccagcctcaacacacacaaatgctgctgaagaagggggcagaccccacccttgtggataaagactttaaaaccgctctccactgggcagtccaggtgagaaattgacctgtg

SEQ ID NO: 107766 - DNA, 2139 bp, Homo sapiens
  Payload ID: 1156
  Gene Symbol: ANKRD55
  Gene Name: ankyrin repeat domain 55
  ENST ID: ENST00000504958
  CDS Start-End: 14-1729
attctgatggtaaatgatgagacaggctaccatggatttcagcaccccttctgtgtttgatcagcaaagaggtgactcatctgaggaagttgacctgaccatggtttatcaagcagcctctaatggagatgtcaatgctctgactgcagtgattcgggaagacccttctatcctagaatgctgtgacagtgaaggatgcacgcccttgatgcatgcggtttctggacgtcaagcggacacagtgaagctgctgttgaagatgggagccaatattaacatgcaggatgcttatggccgcacaagtttatgcctggccacctacctgggctggcttgaaggctgtgtgagtctactcagaaacggtgccaagcacaatatcccagataaaaatggccgcctgccactgcatgctgccactgctgagcccgatatgaggctcctcacggtcctgttgcaacagtcgaacatcagcgagattaatcaccaggacaatgagagtggaaataggattctgtgctccatcattctgagccatcaccaggggccgtccataatcaactatgatgatgagagtgggaagacatgtgtacatatcgcagcggcagcgggcttcagcgatattattcatgagctggcaagagtccctgagtgtaacctgcaggctctggatgtggatgacaggacacctctgcactgggctgcagctgcagggaaggccgaatgtgtccagtcactgctggagttgggaatggacagcaacctgcgggacatcaatgagagcacgcccttggcctatgccctgtactgcggtcacacggcgtgtgtcaaactcctctcccaagagagcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaagcaaaaaacaaaacaaaaaaaaaa

SEQ ID NO: 107767 - DNA, 1518 bp, Homo sapiens
  Payload ID: 1156
  Gene Symbol: ANKRD55
  Gene Name: ankyrin repeat domain 55
  Uniprot ID: Q3KP44
  ENST ID: ENST00000434982
  CDS Start-End: 237-1217
gtccaccatcatccttcgggctcatttaacacttactatttctatactgtaaatggcaacaagattttccctacctcaacctgactttgagcaggagctgttgctggctaagcagcctgaacaattcacatgctcagacgcttgtgcttttttcacatggcccctccaggacacctctgcactgggctgcagctgcagggaaggccgaatgtgtccagtcactgctggagttgggaatggacagcaacctgcgggacatcaatgagagcacgcccttggcctatgccctgtactgcggtcacacggcgtgtgtcaaactcctctcccaagagagcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgca

SEQ ID NO: 107768 - DNA, 3073 bp, Homo sapiens
  Payload ID: 1157
  Gene Symbol: ANKRD6
  Gene Name: ankyrin repeat domain 6
  Uniprot ID: Q9Y2G4
  ENST ID: ENST00000339746
  CDS Start-End: 311-2494
gagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaaga

SEQ ID NO: 107769 - DNA, 5258 bp, Homo sapiens
  Payload ID: 1157
  Gene Symbol: ANKRD6
  Gene Name: ankyrin repeat domain 6
  Uniprot ID: Q9Y2G4
  ENST ID: ENST00000369408
  CDS Start-End: 350-2428
ggacgcggcgggctcggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaat

SEQ ID NO: 107770 - DNA, 2968 bp, Homo sapiens
  Payload ID: 1157
  Gene Symbol: ANKRD6
  Gene Name: ankyrin repeat domain 6
  Uniprot ID: Q9Y2G4
  ENST ID: ENST00000447838
  CDS Start-End: 307-2475
gcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaa

SEQ ID NO: 107771 - DNA, 576 bp, Homo sapiens
  Payload ID: 1157
  Gene Symbol: ANKRD6
  Gene Name: ankyrin repeat domain 6
  ENST ID: ENST00000522705
  CDS Start-End: 223-576
acagttatccagaaactgaacacgatgtagaacagagaggacagcccctcggatgtgagtaccatctcttcaacacaaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcat

SEQ ID NO: 107772 - DNA, 546 bp, Homo sapiens
  Payload ID: 1157
  Gene Symbol: ANKRD6
  Gene Name: ankyrin repeat domain 6
  ENST ID: ENST00000523798
  CDS Start-End: 241-546
ctcctggctgcttcctgatgtcttgctggcagcaagtgggctagggtcggcttgcccagaggggcgcatccaggtggggttcacctttctgaaccaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggac

SEQ ID NO: 107773 - DNA, 737 bp, Homo sapiens
  Payload ID: 1157
  Gene Symbol: ANKRD6
  Gene Name: ankyrin repeat domain 6
  ENST ID: ENST00000518150
  CDS Start-End: 48-737
gaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcat

SEQ ID NO: 107774 - DNA, 574 bp, Homo sapiens
  Payload ID: 1157
  Gene Symbol: ANKRD6
  Gene Name: ankyrin repeat domain 6
  ENST ID: ENST00000522779
  CDS Start-End: 412-574
acaagactttcagaagctgtgacgagcagactagcaagccacaaaacattgcaagctgaatggatgtcttaataagcttttagatgtgatttggccagcatcagcagaggaggctaacgggaaaaggcagcgaacattgtaacgtaaatcactgcagatttgctgggagtgacagccctaggaagctaatgatctctccaggaaagaattgaccacagttatccagaaactgaacacgatgtagaacagagaggacagcccctcggatgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagggggaccagaccgccttgcaccgggccacagtggtggggaaca

SEQ ID NO: 107775 - DNA, 829 bp, Homo sapiens
  Payload ID: 1157
  Gene Symbol: ANKRD6
  Gene Name: ankyrin repeat domain 6
  ENST ID: ENST00000465722
  CDS Start-End: 304-829
aactgtaagtagcgagcttggtttccatgagtcacatgtgtccacagaataggcccaactagacaacagatctgtgggaatgtttggctctccatgaaccacaaagactcctccaacacagaggtgcagtacccacctgggccaaggagggaagatgcaggtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagaca

SEQ ID NO: 107776 - DNA, 514 bp, Homo sapiens
  Payload ID: 1157
  Gene Symbol: ANKRD6
  Gene Name: ankyrin repeat domain 6
  ENST ID: ENST00000524056
  CDS Start-End: 1-230
caggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatctgcctgactgcagtgaacacaacctggcatgaaaaagaactcagggatgtccagttaaactgacgagtggatgttacccaaagcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccaga

SEQ ID NO: 107777 - DNA, 455 bp, Homo sapiens
  Payload ID: 1157
  Gene Symbol: ANKRD6
  Gene Name: ankyrin repeat domain 6
  ENST ID: ENST00000492158
  CDS Start-End: 1-455
gcatcggtgttcatccccacccccaccccatgagttcagggcgtatcagctctacacattgtaccggggcaaggatgggaaagtgatgcagatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgt

SEQ ID NO: 107778 - DNA, 2489 bp, Homo sapiens
  Payload ID: 1157
  Gene Symbol: ANKRD6
  Gene Name: ankyrin repeat domain 6
  Uniprot ID: Q9Y2G4
  ENST ID: ENST00000520793
  CDS Start-End: 2-1993
catgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaatt

SEQ ID NO: 107779 - DNA, 514 bp, Homo sapiens
  Payload ID: 1157
  Gene Symbol: ANKRD6
  Gene Name: ankyrin repeat domain 6
  ENST ID: ENST00000521004
  CDS Start-End: 1-393
aagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtaacccacacacagagagcccttttgtccaaaaggaacacgaccagcagctcttgtactctcctgcactgaaaggcagtacgtatgctagggctgtgggaaacactggatggtaaagtgcactctgtaggggcaaggactgtattttgctcgtaaccatatactcagttgctatgtaataataaagcactcatttatgtgctcaaacttatttgaataaaggaattaaagaattgt

SEQ ID NO: 107780 - DNA, 1427 bp, Homo sapiens
  Payload ID: 1157
  Gene Symbol: ANKRD6
  Gene Name: ankyrin repeat domain 6
  ENST ID: ENST00000485637
  CDS Start-End: 257-1180
agatttgctgggagtgacagccctaggaagctaatgatctctccaggaaagaattgaccacagttatccagaaactgaacacgatgtagaacagagaggacagcccctcggatgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtaggatttactgccctttccatggtactgattatgcgggactacaaagttgttgggactcctggttgcaatctactgaagcctcttcaaactaacttaaatatggaatgtaaccaggcagtggaggtataggcatgcatgggggcccaggatgacgggagtcaaaggcatcaagtccagctcttcgtgttcatgcctgggccgcctcatcttctccctgtggctggatctttgtcacggccagctgcctaggtcatagtttcccagctactcagccaaggaagaagttccagtttaagacatcgcaggacagggccatgattgcagagtttaggccaaatgcccatccctgaagaagtgggacagggactttaagaag

SEQ ID NO: 107781 - DNA, 3157 bp, Homo sapiens
  Payload ID: 1157
  Gene Symbol: ANKRD6
  Gene Name: ankyrin repeat domain 6
  Uniprot ID: Q9Y2G4
  ENST ID: ENST00000522441
  CDS Start-End: 642-2825
gaggcagtttattacagatttcaaccctttctgcatccctccctcccttacaacacgcacactcatcttttcttgcattactgctgaaattatgcaaacttcgtttctctgtcatctgagcgtcattcagaaatgttcctccgatctgtgaattgttccctgacttcaatcggggcagtgttacaggtcctctgctggcaggagggagcagtccgtgaaaatctgcagacacaagactttcagaagctgtgacgagcagactagcaagccacaaaacattgcaagctgaatggatgtcttaataagcttttagatgtgatttggccagcatcagcagaggaggctaacgggaaaaggcagcgaacattgtaacgtaaatcactgcagatttgctgggagtgacagccctaggaagctaatgatctctccaggaaagaattgaccacagttatccagaaactgaacacgatgtagaacagagaggacagcccctcggatgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcaccgggccacagtggtggggaacacggagatcatcgcggcgctcatccacgaagggtgtgccctggacagacaagacaaggatgggaatacagccttgcatgaagcatcctggcatggtttcagccagtcagccaagctgctcattaaagcaggagccaacgtgcttgccaagaacaaggcggggaacacagctctgcacctggcctgccagaacagccactcccagagcacgcgcgtcctcctgctggccgggtcccgcgctgacctcaaaaataatgcaggagacacctgtttgcacgttgctgcgcgctataatcacttgtccatcattaggctcctcctcactgctttctgttctgtccatgaaaagaaccaggctggagacacagcacttcacgttgctgctgccctaaatcacaagaaggtggccaaaatcttactggaagccggagcagatacgaccattgttaacaatgcaggccagactccgctggagactgcccgctaccacaataacccggaagttgctcttctccttactaaagctccccaggtcttgcgcttcagtcgtgggcgaagcctgaggaaaaagagagagaggctcaaggaagagaggagagcccagtctgtgccaagagatgaggtggcccaaagcaagggcagtgtctcagcaggagacacccccagcagtgaacaggctgtggccagaaaagaagaagccagagaagagttcctgtcagcctccccagaacccagagcaaaggatgacaggaggagaaagtcaaggcccaaggtgtcagcattttctgaccccaccccaccagccgaccaacagcctggacaccagaagaacctgcatgctcataatcaccctaaaaagaggaacaggcatcggtgttcatccccacccccaccccatgagttcagggcgtatcagctctacacattgtaccggggcaaggatgggaaagtgatgcaggcaccaataaatggttgtcgatgtgaacctctaatcaacaagctggagaatcagttggaggctactgtggaggagataaaagcagagctgggatcggttcaggacaaaatgaatacaaagctggggcagatggagaataagacccagcaccaaatgcgtgttttggacaagctgatggttgagcgactttctgcagagaggacggagtgcctgaaccgcctgcaacagcactcagacacagagaagcatgagggggagaaacgacagatatccttggtggatgaattaaaaacctggtgcatgttaaagattcagaatctggagcagaagctttctggagattctagggcctgcagagctaaatccacaccatctacttgtgagtcctctacaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattc

SEQ ID NO: 107782 - DNA, 539 bp, Homo sapiens
  Payload ID: 1157
  Gene Symbol: ANKRD6
  Gene Name: ankyrin repeat domain 6
  ENST ID: ENST00000520458
  CDS Start-End: 300-539
agttttggtttggccattgacatgtaaatgtcagagaggcctgaggctgttccccagtggaccctcccgccttcccacacaaagccctggctctgtgagggccatggctttgcctttgtgaggcctgggccatcccagctgcagagggaagtccccgtcccgaagatggcatattcataaagacatcttctgatgattgtgaacatctttacctctgggtgccaggccgggccagtgacttcgtgttgagctgaaggaacttgtctaccgcttccctgaaaacctttctttcctaattcatgagccagcaagatgcggtcgctgcactttcagagcgccttctcgtagctgcgtacaaaggccaaacagagaatgtggttcagctcatcaacaagggcgccagggtagcggttaccaagcatggccggactcccctgcatcttgctgccaataagggccatcttcctgtggtccagatcttgctgaaggctggctgcgaccttgatgtccaggatgatggggaccagaccgccttgcac

SEQ ID NO: 107783 - DNA, 1038 bp, Homo sapiens
  Payload ID: 1158
  Gene Symbol: ANKRD60
  Gene Name: ankyrin repeat domain 60
  Uniprot ID: Q9BZ19
  ENST ID: ENST00000457363
  CDS Start-End: 1-1038
atgacgcgcggccgcgcctgggggatgcggcgggcggcggcgggggcgggcggagcgcgggcggcggggccaactgggggcgcctctcgcctgcaccccaatgcgggacgcaggagcggtgcgcgggccggggctcaggggtgcggcgggcccagggtgggctcggcggactcgcgggccctccccgcgcagcccctggcctgtgcccgcggccggagccagcggctcgtctgtgacccgaaggccgcgagtgccttgcccgacttggcccctgacgtcttcgtcctgcgggtgcggctggaggagacgggggagatgttccgagtggcaaactgccgcggcgacatgaccgtgcgggagctcaaagaggagctggacctgatggtcggcatccccttcaacctccagcggctccagtacctcgacgaaggagttttgatggatgacactaccctgaagttccatgatgttgttcctggagggattatttcattatgtatctggcatcatgacggatggacagaacttgttttggcggctgtggaaggggatcccagcaagctatcttgtctcgggcttactgaagattccttctaccgaaccgcaaattcagaacattttgagggtgagaagtggaagcactggacgtctcagagggcgtttgtggcgttgtatgtggcctcacacagaggccactttgatgctgtgcagtaccttctagaacacggagccagctgcctcagcagatcccccctgggcaggacacccctgcatgtggctgcagctatgggccggtcagactgtataatcctcctgctccagcacggggcctccatccacgacagagatgccaagggggagacccccatctccattgcacaccgcctgaaccacacactgagcgagaggcagatggtcctcctccaccggatagcaaagtcggggataagggatctgaatgacttggtcatgaagaatgctttgcagagggtcaagtctgggtttaggtctgagaagatgacgatgacccctcattag

SEQ ID NO: 107784 - DNA, 1257 bp, Homo sapiens
  Payload ID: 1159
  Gene Symbol: ANKRD61
  Gene Name: ankyrin repeat domain 61
  Uniprot ID: A6NGH8
  ENST ID: ENST00000409061
  CDS Start-End: 1-1257
atggggaatataaccaggaaaggaagcagagacctggtggttgacagtgccaagtccctggaagatggcccatctgcagcacttcactcgaaactctatgaagccatcatgagagaagactgcactacgatcgaggtactcctgagaaatcaccctgtcaaccagcccatcaccattctgcccaactccgccagcaacagattacttctgacccagccgacagagtctatcatccccatccatctggctgccaagtaccacaaggcccagagtctgctctgcctgttacggcacggtgctgacccagaagtcagggacacgacaggcctcaccacactcaacttaatgctactgcactggccagtcacttccaccacgtgggcaaaaccaggcaacagaacgcacaggatcctgacagacattcagaatagcagcatcacatgtctccgcatcttgtgtgcgcacggagctcaagtgaacactcaaggggaaatcagcaacaaacgttcaccactccacctggccatagcatatggttgctatccagttctctccattttgacccaaaatggtgccgatgtcaatgctattaatgaagccagcatgacaccccttcacatggccgcaaacatgctgaataaggagatgatggaaacgctcattgcctatggagcaaacgtcaactgtgctgtctcttccacggggaacacgcccctgaagcttgcagtgtgcactgcatcaagcaaagcaggccgactcctcggggcgggggtcagctgcatccgtctgctactcactcacggagccaaagtcaacgcccaggactacaagggccaaacagccatccatgaggcatgctttggaggcagagaggcaatcatcaatctcctgcttgaatttgaagcaaatgttaacattttaacaagaaacggggaatctccaatttatatgtaccttcagcgcagttgcaatgtaagagatacggcacttctggccaggctactttatcacacttatcctctgagaatgaccaataaccaaggaattctacctgcaggaatcatgctaccagaattccgcctcttaagggacaccctaataaagcaatcgcaaaaacctttatccctacagggtatctgcaaaagaaacatcaggaatatttatggtgagaaatacaaacagcacttgaagcaattcctcccagtgacaatatggaattctgtctactgctgttatgacttggcatatacctcttga

SEQ ID NO: 107785 - DNA, 2919 bp, Homo sapiens
  Payload ID: 1160
  Gene Symbol: ANKRD62
  Gene Name: ankyrin repeat domain 62
  Uniprot ID: A6NC57
  ENST ID: ENST00000587848
  CDS Start-End: 166-2919
ggctaggtgctcctccgagcagctggagactggagtgtccctgacggaggttgcggctggacctggttacgtgctggtgctgcgctccagagaggcagaaaacgagtgggagctgaggtgtcttaaagccgttcctcagcctgggagaagatctctggcttcaggatggaggtcagggggtcgttcctggcggcctgcaggagacgcatggctacctggaggaagaatcgtgacaaggatggcttctcaaatcccgggtaccgagtccggcagaaggatctgggcatgatccacaaagctgccatcgcaggtgatgtgaacaaggtgatggagagcatcttgctcaggctgaatgacttgaacgacagggacaagaagaacaggactgctctacttttggcgtgtgcccatggccgtccaggagtggtagctgacctggtggccagaaaatgccagcttaacctcactgacagtgaaaacaggacagctctgatcaaggctgtacaatgtcaagaagaagtttgtgcatccatcctgctggaacatggcgccaacccaaatgttagagatatgtatggcaacactgctctgcactatgccattgataatgagaatatatcaatggcaagaaaactgcttgcatatggtgcagatattgaagcaagaagccaggatggacatacatcacttttactcgctgtaaataggaaaaaagagcaaatggtggcatttttgttgaagaaaaaaccagatttaactgcaatagataattttggaagaacagccctgatacttgctgctcgtaatggatcaacaagtgtagtctaccagcttcttcagcacaatattgatgtcttttgccaagatatatctggatggactgcagaagactacgctgttgcttctaagtttcaagccattcgtggaatgatttctgaatataaagcaaacaagagatgtaaaagtcttcaaaatagcaattcagaacaagacttagaaatgacatcagagggagagcaagaaaggcttgaaggatgtgaaagtagccagccacaggttgaagaaaaaatgaagaaatgcagaaataagaaaatggaagtgtcaagaaacgtacatgctgatgacagtgacaattataatgatgatgttgatgaattaattcacaaaataaagaacagaaaacctgataatcatcaatctcctgggaaggagaatggcgagtttgataggcttgcaaggaaaacctctaatgaaaagagcaaggttaaaagccaaatatatttcacggatgaccttaatgacataagtgggtcatctgaaaaaacctcagaggatgatgagttgccttactctgatgatgagaattttatgttactcattgaacaaagtggaatggagtgtaaagattttgttagcctatcgaaaagcaagaatgcaacagctgcatgtggaagatcaatagaggatcaaaaatgttactgtgaacgacttaaagtaaaatttcaaaaaatgaaaaataatattagcgtactacaaaaggtactatctgaaacagacaaaaccaaatcacagtcagagcatcagaatcttcaagggaaaaaaaagctctgtaatttgagatttatcttacaacaacaagaagaagaaagaataaaggctgaagagttgtatgaaaaagatatagaagagttaaaaataatggaagagcaatataggacacaaactgaagtgaaaaaacaatctaaactgactctcaaatcattggaagtggaattgaagactgtaagaagtaactcaaatcagaattttcatactcatgaaagagaaagagacctgtggcaggaaaatcacttgatgcgggatgaaattgccagactcaggctggaaatagacacaataaaacatcagaaccaggaaactgaaaataaatatttcaaagatattgaaattataaaggaaaacaatgaagaccttgaaaagactctcaagcggaatgaggaagcattaacaaaaacaataacccggtatagtaaagagcttaatgttctgatggatgagaatacaatgctcaattctgagctacagaaggaaaaacaaagcatgtcaagactggaaacagaaatggaatcataccgttgtagactggctgctgccctatgtgatcatgatcaacgtcagtcatcaaaaagagacctacagcttgctttccagagcacagtgaatgaatggtgtcatttacaagaagacactaattctcacattcagattctttctcagcaactttctaaagctgagagtacatccagtggcctggaaactgagctccattatgaaagagaggctctcaaagaaaagacgttgcatatagaacacatgcaaggagtcctaagccgaacacagcgtcgattggaggacattgaacacatgtaccaaaatgaccaacctattttggaaaaatacgtgagaaagcagcaatctgtagaggatggactatttcaactacaaagccaaaatctgttgtatcaacagcagtgtaatgatgctcgcaagaaagctgacaatcaggagaaaacaataattaatatccaagtcaaatgtgaagatactgtagaaaaacttcaagctgagtgtagaaagctagaagagaacaataaggggttgatgaaggaatgcactcttttaaaagaaagacaatgccaatatgaaaaagagaaagaagaaagagaagtagtcaggagacagcttcaacgagaagtggatgatgccctgaacaaacaattgctgttagaagctatgctagagatttcatcagaacgtcgtattaatttagaagatgaggcacaaagtttaaaaaagaaattaggccagatgagaagtcaagtatgtatgaaacttagcatgtcaacagttactctgtag

SEQ ID NO: 107786 - DNA, 1143 bp, Homo sapiens
  Payload ID: 1161
  Gene Symbol: ANKRD63
  Gene Name: ankyrin repeat domain 63
  Uniprot ID: C9JTQ0
  ENST ID: ENST00000434396
  CDS Start-End: 1-1143
atgctcaaacccaaggacctgtgcccccgagcggggacgcgcaccttcctggaggccatgcaggcgggcaaagtgcacttggcccgcttcgtgttggatgcgctggaccgcagcatcatcgactgccgcgcggagcagggccgtacgccgctcatggtggccgtggggctgccggaccccgcgctgcgcgcgcgcttcgtgcggctgctgctcgagcagggtgctgcagtgaacctgcgagacgagcgcggccgcaccgcactcagcctggcgtgcgagcgaggccacctggacgccgtgcagctgctggtgcagttcagcggtgaccccgaggcggccgactctgcgggcaacagcccggtgatgtgggcggcggcctgcggccacggggcggtgctcgagttcctggtgcggtccttccgccgcctaggcctgcgcctcgaccgcaccaaccgtgcggggctcaccgcgctgcaactggccgccgcccgcggccacgggacctgtgtgcaggccctcaccgggccctggggccgcgccgccgccgccgctgcggcccggggctccaactccgatagtccccctggccgcccggcccccgcggccagccccgagcatcgacgacccagcccccgccgcctcccgcggcctctcctggcgcgctttgcgcgagcggcgggcggccacggcggcgaggctggctcagcgggcaagaattcgggccggcaccgggcgcagggcagcgaacggcccgagctgggtcggagcatgagcctggctctaggtgcggtaaccgaggaggaggctgcccgcctgcgggctggggccctgatggccctaccaaactcgccccagtcttcggggactgggcggtggcgctcacaggaggtgctggagggagcgcccccaaccttagcgcaagcccccattggcctcagtccccacccggagggcggccccggctctggccgcctgggtttgcgccgacgctccacagccccagatatccccagcctggtcggggaggcgccagggcccgagagtggcccggagttagaggccaacgctctgtctgtctcggtgcctgggccgaacccttggcaggcgggcaccgaggctgtggtgctgcgtgctcagcggtaa

SEQ ID NO: 107787 - DNA, 876 bp, Homo sapiens
  Payload ID: 1162
  Gene Symbol: ANKRD65
  Gene Name: ankyrin repeat domain 65
  Uniprot ID: E5RJM6
  ENST ID: ENST00000442470
  CDS Start-End: 256-780
gcagacactccaccccaaagcctgcagaagggattttgtgaagagggtcaccaggctgagcctcggccagaacccgtctacagaggaccctcagccagagcagaaagctcctgagccagctcccttgggtaacagagccaagcccctctgaaggctaagtggtaactggaatggggggctccagttggcctgggacacggctgggggcaggccagaggcctccacagtggatgtaggatccctgctcccccccagatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggg

SEQ ID NO: 107788 - DNA, 1976 bp, Homo sapiens
  Payload ID: 1162
  Gene Symbol: ANKRD65
  Gene Name: ankyrin repeat domain 65
  Uniprot ID: E5RJM6
  ENST ID: ENST00000427211
  CDS Start-End: 638-1162
tggagtccttggtgaatcttttgtcctgtccagcatttacagaaaggaaggccagaacctcaccctgccctcctccccagcctggaatcgggaggaggggccggcacccacccctgggtgggcttagccagctgggacaggagtgggtgagggggctgcccgagggtgggccccatggagagccctgtgaggccttccaggggcacatcggggtacatccaaggctgcgcttcctgggggaggtggcgtctgagcaactttcgtccacaagcatgttcctgcttgtcctccccaaccgcctggcctttgttccccaggagggcagccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctacaa

SEQ ID NO: 107789 - DNA, 1632 bp, Homo sapiens
  Payload ID: 1162
  Gene Symbol: ANKRD65
  Gene Name: ankyrin repeat domain 65
  Uniprot ID: E5RJM6
  ENST ID: ENST00000520296
  CDS Start-End: 313-510
ccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctacaa

SEQ ID NO: 107790 - DNA, 2190 bp, Homo sapiens
  Payload ID: 1162
  Gene Symbol: ANKRD65
  Gene Name: ankyrin repeat domain 65
  Uniprot ID: E5RJM6
  ENST ID: ENST00000537107
  CDS Start-End: 313-1512
ccgaactggggccctggcagccagcaggggagggagtatgttggacagggggctgtgcccgaaggcagggccttcctaagtggctgagtaaacagcgtcaggtggcctcagcctggcccaggggaccagctgtgttctcccaccccctgcaaggctgaagctgccaccattcagcttttcagcagcagacactccaccccaaagcctgcagaagggattttgtgaagagggtcaccaggctgagcctcggccagaacccgtctacagaggaccctcagccagagcagaaagctcctgagccagctcccttggatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagagggaccacgcaggccggaccccgctccacctggccgtgctgcggggccacgcgcccctggtgcgtctcctgctgcagcgaggggccccggtgggcgcggtggaccgggcggggcgcaccgcgctgcacgaggccgcctggcacggacactcgcgggtggccgagctgctgctgcagcgcggggcctcggcggcggctcgctccgggacgggcctcacgccgctgcactgggccgctgccctgggccacacgctgctggccgcgcgcctgctggaggctccgggcccgggacccgcggcagcggaggcggaggacgcgcgcggctggacggcggcgcactgggcggccgcgggcgggcggctggcggtgctggagctgctggcggccggcggcgcgggcctggacggcgccctgctcgtggctgccgctgcggggcgcggggcggcgctgcgcttcctcctggcgcgcggggcgcgggtggacgcccgggatggcgcgggggccacagcgctgggtctggcggccgccctaggccgctcccaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccatacttcaacaaagaatgagttgtggcaatgagggaagagagaccctctcatagtgttttatactcagtacctgttttaagaaaaaacaacaaggaagtaaaaccaaagacaggcaggcagcctggcgctaggcccgaaaccaggcctgcgcctgcctggcctaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgcttgctcaaatcaatgacgaccctttcatgtgaaatcttcggtgttgtgagcccttaaaagggacagaaattgtgcacttggggagctcggattttaaggcagtagcttgccgatgctcccagctgaataaagcccttccttctac

SEQ ID NO: 107791 - DNA, 1506 bp, Homo sapiens
  Payload ID: 1162
  Gene Symbol: ANKRD65
  Gene Name: ankyrin repeat domain 65
  Uniprot ID: E5RJM6
  ENST ID: ENST00000454272
  CDS Start-End: 87-1286
aatggggggctccagttggcctgggacacggctgggggcaggccagaggcctccacagtggatgtaggatccctgctcccccccagatggactcccagaggcctgagcccagagaggaggaggaggaggaacaggaactgcggtggatggagctggactccgaagaggccctgggaaccaggacagaggggcctagtgttgtccagggctgggggcacctgctccaggccgtgtggaggggccctgcaggcctggtgacgcagctgctgcggcaaggtgccagcgtggaggagagggaccacgcaggccggaccccgctccacctggccgtgctgcggggccacgcgcccctggtgcgtctcctgctgcagcgaggggccccggtgggcgcggtggaccgggcggggcgcaccgcgctgcacgaggccgcctggcacggacactcgcgggtggccgagctgctgctgcagcgcggggcctcggcggcggctcgctccgggacgggcctcacgccgctgcactgggccgctgccctgggccacacgctgctggccgcgcgcctgctggaggctccgggcccgggacccgcggcagcggaggcggaggacgcgcgcggctggacggcggcgcactgggcggccgcgggcgggcggctggcggtgctggagctgctggcggccggcggcgcgggcctggacggcgccctgctcgtggctgccgctgcggggcgcggggcggcgctgcgcttcctcctggcgcgcggggcgcgggtggacgcccgggatggcgcgggggccacagcgctgggtctggcggccgccctaggccgctcccaggacattgaggtgctgctgggccacggggcagacccaggcatcagggacaggcatggccgctctgcgctgcacagggctgccgcccgaggacacctgcttgccgtccagttgctggtcacccagggggccgaggtggatgcgcgggacaccctgggcctcacacccctgcatcacgcctctcgggaaggccacgtggaggttgccggctgcctgctggacaggggtgcccaggtggatgctaccggctggctccgaaagacccccctacacctggctgcagagcgagggcatgggcctaccgtggggcttctgctgagccgaggggccagccccactctgcggacgcagtgggccgaggtggcccagatgcctgagggggacctgccccaggcgctgcctgaacttggagggggggagaaggagtgtgagggcatagagtccacgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcagtcacaggccttggctggaccagggatggcccccagctcccaggagggcccactgaccctgcagctccagccttctccat

SEQ ID NO: 107792 - DNA, 1346 bp, Homo sapiens
  Payload ID: 1163
  Gene Symbol: ANKRD66
  Gene Name: ankyrin repeat domain 66
  Uniprot ID: B4E2M5
  ENST ID: ENST00000565422
  CDS Start-End: 6-761
atggcatggacacaacactccggatggttaggactgcctgtcagcacagagctcctcaaatttcacacaagacaggctgttctcacatttcaatgcactcacctggagggcttaccacaacaaagatggccggacccctgcccagagtttcagattctttgttttctgccatggaattggccaaaatgtcagacatgacaaagcttcaccaagctgtggctgcaggagactacagcttagtgaagaagattttgaagaaaggtctctgtgacccaaactacaaagatgtagactggaatgaccggaccccacttcactgggctgcaatcaaagggcaaatggaggtgatacggctcctgatagaatatggagccaggccctgcctggttactagtgtgggctggaccccagctcattttgcagcagaagcaggccatctgaatatactcaaaactctccatgcattgcacgctgccatcgacgcccctgacttctttggagacacaccgaagaggattgcacagatctatggacagaaagcctgtgtggcatttctggaaaaggcagagcccgagtgccaggaccaccgttgcgctgcccagcagaaggggctgcctctggatgagcgtgatgaagactgggatgccaagaaaagggagctggagctgtctcttccttccctaaatcaaaacatgaataaaaagaataagaaaagtcgaggccccaccaggcccagcaataccaaggggaggagagtatgagaactcaaccttatgttttctggcaaggaactttccctggtgccagaaatgaggctgttaggcatggtggcctttccatgactttactcatagacccttacccacctggcttctgcccatggacctgtcattaggtgctgtccacatgggctgttgtttcctggctagcacctactgtgtacaataattaccgggaaaggacaaaacctgcttgcattttgtcatcagtggtttgcacagtcagcatcttttgacccctgccccccaacaataatagaatttcaggagacaaggaaactctggcatgaattaacttcatccctgataacgatcgagagataatgtaaaataatgaacatgtgattataggtctactttttcaactgtaaatttgggaaaattaaattcagatcagataattccaataaaaaattgcatccaaattgagatgcaaaatacacattagatttcaaacacttagtacaaaaatataaaatgtctccttaataatacttaatattgattccacattgaaatgataatattttggatattgcgttgaataagatatattaccaaaatgaa

SEQ ID NO: 107793 - DNA, 2551 bp, Homo sapiens
  Payload ID: 1163
  Gene Symbol: ANKRD66
  Gene Name: ankyrin repeat domain 66
  ENST ID: ENST00000445060
  CDS Start-End: 1-221
tgatagaatatggagccaggccctgcctggttactagtgtgggctggaccccagctcattttgcagcagaagcaggccatctgaatatactcaaaactctccatgcattgcacgctgccatcgacgcccctgacttctttggagacacaccgaagaggattgcacagatctatggacagaaagcctgtgtggcatttctggaaaagggaatagaattttgactctatataaatcaagaaacgcctgacttctttagtagtttgtatttgcaagatctaagatcatggtaaacattaggtcctaaaatcttggggaaggacaacatgtccttcctctgacttgttagcaatcaaattgagtaggttttaaatgtctgttaattggaagggtttgttatttcattttcagccaaaggagagaggtgcattttaagtatcagaattagatcagctttgagtttgtactaaatttggaatgtaatagattttcataaattacgtgtgcctttttggaaatgtcaactgtctttatgtctgcttgtaaaagtttcaaaatatgtttttctctcaaaaaggcaacgttatttcatttgcttgaatattatgataggaacgcttactgatattacttgatagttttatatagccttggaactttaacatataatatagcagtattaatcatgatagttgtacttctttgaaacattaaatttgaggaaactaatctatgtaattgtctccacttcttcacctctcacccacgcttcagacttcttccctgatccccatactgaatcagctgtcactcaagtcattagggagctcctcacgctaaatcaattgcctcttctcaattcacatcttacctccacttaattcggtatttaatattcctgaaactcttctcccttgttttatctgatgctattctcttttagtttttcttctacttctctgataattccttatgacttttaaaatgtgctttttctaagaataaatcttatgatatgttcttgcgtgccttttaaatgctgacattccttagggtcctgcccttggctgtcctctactgactctctctaagtaatcccagcccctccctagtgaccagggatcaacatgaaatatgatcccagcataactgaaatgcaggaggggtgcttgcctccaaatagtggggagtgctattaccaagaaaagtaggcagacagtgttgagccagcaaaaacaataaaggtcagtcacatcacgtgtgagtcatttctacttattatcagctcccactaagaacttccctgacagagcgtttagggagaagaatcctgaattaaggggggattaacctggatcttgaaagctagctggctaatgaaggagggagaaaaactgttgatttagagtgaaggcaccaacttggaaatgtgcataggttgtgtgtatatgtgagaaggtgagggatagtggagtgcagggatgagtggcctggctaggcagagcattcacactagagaggaatggagcataaggtcaggtgacggggtgggtgaccacagtgaactaggcaagcagaagagtgtgagctcatcaggggagtcacaagctgaaacagatgcattagcaatttatttgtgtagtagaggagttggcagtggtactgcgtgggattgaagactgctagactttaggcaaggggatcacttaaggaatttcttattgattcacattttgagtaagttggctcctgggctaggtgatgaagataaaggatataagagaacttcaaaagaagcctagaccatatgtgatcattttctgaatatcctagggaatgttgtgaaacaattcagcttttgattcagccccccaagtgataaacctctcatttagcaaatatttttgagttctactatgtgtatgtcattgagttagacactaaaaacaacctaaaataaaccagatacagtgctggacatcaagaaggttaactgtgtgggagacgaaataacttgtttacataaataacactaatacaagacagagagtgactaggcagaggaaagacatggtgtggtctgaagattgaaaggtcacttccagcttagggtgagggactagtgagtttgctgtcctttgaatgaactgtgcttttaataatggtttgcacttaaaatgctatttgccttccctataccattatctatcctcttaaattccatttgtcctcatattggttcaaaagtgacttttccaagtacctttaagcaagtcacatactcaccattggcctcatacaaaactgtatatgtgtgtatttcccattgtctatgtgtgtataatgctctatttatttatccatccatgtatccatttacaattatatgtatttttacagaatccatacatacgtataatacatatgtgattgtgagtgattctcattttgttccttatatgtttctgtacttttaaattttatacaaggaacacacatcacttttatgattatgaaaaataaaactaaaaataaacgaaaacagtctcgcaat

SEQ ID NO: 107794 - DNA, 1298 bp, Homo sapiens
  Payload ID: 1164
  Gene Symbol: ANKRD7
  Gene Name: ankyrin repeat domain 7
  Uniprot ID: Q92527
  ENST ID: ENST00000265224
  CDS Start-End: 156-920
ataacggccggctgcgcgaggcccttccagcatttccactttcgtcaggtactggagagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctac

SEQ ID NO: 107795 - DNA, 1242 bp, Homo sapiens
  Payload ID: 1164
  Gene Symbol: ANKRD7
  Gene Name: ankyrin repeat domain 7
  ENST ID: ENST00000417525
  CDS Start-End: 101-892
agagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttcagctacaaa

SEQ ID NO: 107796 - DNA, 436 bp, Homo sapiens
  Payload ID: 1164
  Gene Symbol: ANKRD7
  Gene Name: ankyrin repeat domain 7
  ENST ID: ENST00000486422
  CDS Start-End: 125-436
atttccactttcgtcaggtactggagagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagtgttgtccaatcttctagatggcttttatcctacaccactccgctgaatgactttataagaacacctttgcacctagcctgtgctaatggacatacagatgttgtacttttcctaattgagcaacaatgcaaa

SEQ ID NO: 107797 - DNA, 1061 bp, Homo sapiens
  Payload ID: 1164
  Gene Symbol: ANKRD7
  Gene Name: ankyrin repeat domain 7
  ENST ID: ENST00000622000
  CDS Start-End: 237-689
tttaaagaaacttcacagagctgcttcagtcggggatttgaagaagctgaaggaataccttcagatcaagaaatatgatgtaaatatgcaggacaaaaaatacagaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtgactaaaggaagatatggaacccatttctacaatttctttgccgcttccttgaattggaaaaatgtactttgaaagaaccgttaagtgaactattataatatttttgctgactacccagttgaagaaaagtttgttaattggatgggattttttttttttcacgttagaagacatgaagaaattttaaaagataaacatctatattgtgaaccatcagctgaaaagataaatttgtgttcaatatataggcagaaaaaaatttgtgtcaaaatgttgaatggaataataatgaggaaactgtgttaggcatgtattaaaacatttaaataaaataaaaatacatttc

SEQ ID NO: 107798 - DNA, 744 bp, Homo sapiens
  Payload ID: 1164
  Gene Symbol: ANKRD7
  Gene Name: ankyrin repeat domain 7
  ENST ID: ENST00000477532
  CDS Start-End: 470-718
ggtctttgctaggtctggaggtagagcagatgctgaggcgttcaaaggaaggcggtgcctgtggacaagcaggcttgcacaggatctggcccgtgccgaccagggcgccaggaccctgaaagtctcgtcccaaacacctttgcacctagcctgtgctaatggacatacagatgttgtacttttcctaattgagcaacaatgcaaaataaatgtccgggatagtgaaaacaaatccccattgattaaggcagtacagtgtcaaaatgaggattgtgctactattcttctaaactttggtgcagacccagatctgagggatattcgttataatactgttcttcactatgctgtttgtggtcaaagtttgtcattagttgaaaaactgcttgaatacgaagctgatcttgaagcgaaaaataaggatgggtatactccactattagttgccgttattaacaataatccaaaaatggtaaaatttcttctggagaaaggggctgatgtgaatgcttcagataattatcaaagaacagcccttattcttgctgtcagtggtgaaccaccatgtttagtaaagcttcttcttcagcaaggtgtggaattatgttacgaaggtattgtggattcacagctgaggaatatgtttatttccatggttttactgcatagatacccacaattcactgcgagccatggaaagaagaaacatgctaaatagacaccttattcttggcactacatgtg

SEQ ID NO: 107799 - DNA, 6727 bp, Homo sapiens
  Payload ID: 1165
  Gene Symbol: ANKRD9
  Gene Name: ankyrin repeat domain 9
  Uniprot ID: Q96BM1
  ENST ID: ENST00000286918
  CDS Start-End: 598-1551
gacggtcccgctgtcctgcctggccggggccgcactgcgccgcccgccgcccgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgccccccatggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctatctcctcccaggagctaacgtataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcacaatctctgcctcatctgtcgcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggtcagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttattgaggggtggttgtatcactgtagggacaggcttcttgccccagcctggagagctgttttcttcaggaaggttctggagatggagacttgtttgcgaattcaccacaactccaggctgggaggctgggtctccgctctcagagccgagacaccagggaggatagccaggctgccctgcctgggaattctgctgggccgtcaaattcaacccgcaccaacgtgggcaggagggccacagtgtcctgccaggagcagagggctgaaggtctgcaggaggaagaaccactatcctggtggggggcacctgctgcccaccctgcccccagcgtgcctggggggagcacacctgggcatggaggagtccagggtgctgggccacacaagagaggtgggggagaggcctggacagtaggaagatcttgcccagggtcctggatccgccactctgggggtgaccttggacaaacctctgccttggccctcagtctccccatcaaggtttttccattcaggaggttttgggccatcttcagccaccctaccagccctgaaaaggatgtgactcctgtttctgggaagtgtgtggtgtgttaggtgggcctacagccctggttgtggggagggaaggatggagagacagcacagtgacagagcccagactgcaggctggagtgagggttccacttccccgctgctgtgtgtcctggaccagtgcctctgaaccttggcacttggggcagtggatattaacatctttccaagcccaattcttggggcatcagggcctccggtcctctgggaggtggcaggtcctcagattggagatgccatgggggggggaggtgcctctcctttggagggtatggaagtggagacaggagtggcctggcgcagctgccgtggttcttaggggctgggcccggggagcccatggggcttgtgcctagaaagcctgggctcctcactggggtctagatgtgcagacttcatgtctccccagctccagctctgttctctataggtcagcctccacaatgccagaggcccagggctagccccctccacgtccctcctagatctacagctgcccctttgatgacagcgccattgagtcccctgggctgggggggtcatgcaggggtgaggcagctgcctgccgccggtactcattgcctggccaggcaggacacaggctggcgggcactgagagtgggccccacgaaatccattgtcaggttaccaggatgaagaacccaggctggtcgtggagtgcagggcggggcctgccggaagaattatgggcactgcagcaggagggcagcctgggccattagctcctgatgtcatcgatttgggtgaggggacagggaagtcagaggaagctggccagtggctctcacgaagacttacagcagcggagtggtgcctgattcctagtacagctgctcccactgagtctccagggatctgtggttcaggaccccctgcaaccccctcccagacccctgtactggtgggaggagaggacctagaggaaaggtgctgggcagataagcagccgagggaggccctgggtttagcttatcagtcttctgggccctcctgccccaggaagggcagcgaggaccatggtgttgcccctgtcatcgttatcgtcctggccatgagcttgcaggactgggagggccggagtcagccaggcagacggcagcacagcatttgcctgttggcaggtggccttggtggcttcccaaaggcaatcgctccacgcagaacaaaactcacttttttggggggtgaagcaccttggttcatttgtttagttcgttaattccagcagtctgtttctaagggaaacatggctgcagccggtcctgcccctccacccacccaccaggtgcccagtgttcccaagggccccgaatcccaaccttattcaggcgtcagcatctctgcaccccaaatgcctgttagggaggatagtgaaggctgagccctcctgggctcatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctactgtgacttccccttctgtcgacttcctcaccaactttaaaattccgtattgagagcagtttcctaagttacctcaaatcctattcagaagaaggttcttcctggaagttgggagggcggaaaacaagtttagtcacagaagactactccatgtttgagcttctgtttcaagggaagtgagtaactgccggaggagccctgcccctctgcagtgtgtggtgttgccctgatacttttcagattgaggtgttacttacatgtaataaaatgcacagacttaagtgtatactttgatgagttctgatgaatgtctacatgtgtgtaatcaccactgcaatcaagatggaaggaaaggctgggcgcggtggctcacacctgtaatcccagcactttgggaggccaaggtgggtggatcatgaggtcaggagttcgagaccagcctgaccaacatgatgaaaccccgtctctactaaaaataaaaaaattagccaggcgtggtggcaggcacctgtactcccagctactcaggaggctgaggcaggagaattgcttgaacccaggaggcggaggttgcagtgagccaagattgcgccattgcactccagcctgggcgacagagcaagactccatctcaaaaaaaaaaaaaaaaaagatggaaagacagatttctattggtgattcttaaaagtaatttatttatttatgtatttatttatttatttgagatgtagtcttgctctgtcatccagactggagtgcaatggtgtggtctcagctcactgtaacttccgcctcctgggttcaagcgattctcctgcctcagcctctggagtagctgggattacaggcgctggccaccacgcccggctaatttttgtatttgtagtagagactgggtttcagcatgttggccaggcaggtctcgaactcctgaccttgtgatccgcccgcctcagcctcccaaagtgctggggttacaagtgtgagccactgcgcctggctcttaaaagtaatttctttctgcttataaaattcatgttcactgtagaacactggggattgagtagagaggtccggccacgatgcagggaaacactgtctcaagcgccccaccgccccacatggtccccagagacagggcccctaagcgctcacgtacaagtaaaggcgctgactgagtgcgtcatctgcacgcatacaagcactgctagcattctggcatatgtttctttcagcttttttctgtgcagatatatattacatttttttctgtgtatatttatatatatatgaaaccagatcagttacacaatttagtatttttttaaccttaatgtagtataagcatttcccccattgtactttgtaaatatgatttttaagaagtcattggtgtctactttgtgatatttgactcaaccagccttgataacaaagagtagttagagacaactgaatttttaaaatgtaaatctgctttatttttggaataaataatacatttacatggctggaaattcaaaggatacaaaaaggcatatactccaggcaaccactatgaccagctgctgatcacaagtagagaacttgtttcttttcacccctcttgctcctccccggagttatgaaaaatttcaaacctgccaaaagtttgaagtttacaacaaataccctccaacgtttgggttgtctccctcccccttctctccctttctccctctgatttcttacagaaccacgctttcatgaccatgcccgggaacttcacgctggcgcggtgaggtcctgcgcctccgcttcctgcacacacgtgcttcttaatagctgcaggctatttcatgagaggaatttgctcacgttaacatggctgttcccaaatgccaggctgttttaagtgtttcctaattataaacaggctgtgctgtttcccttgacctaggacttgttcttgaggacagaagtggaggtggcgagatgcaaggcctacgtacggaccggcttccccagtagggcggcgccaatggggggctcccaagctgctcccatctcacctctgcttccggggtgctgggggtttgggccagtgttccttctgcttttgtgaagggcccttacactcgactcgaagtgctcctcctattggtttttaataaatatatttatggaaagctttat

SEQ ID NO: 107800 - DNA, 1502 bp, Homo sapiens
  Payload ID: 1165
  Gene Symbol: ANKRD9
  Gene Name: ankyrin repeat domain 9
  ENST ID: ENST00000559404
  CDS Start-End: 724-1502
ggcgccccacgcgtgccggcacagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctatctcctcccaggagctaacgtataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcg

SEQ ID NO: 107801 - DNA, 1413 bp, Homo sapiens
  Payload ID: 1165
  Gene Symbol: ANKRD9
  Gene Name: ankyrin repeat domain 9
  Uniprot ID: Q96BM1
  ENST ID: ENST00000560748
  CDS Start-End: 400-1353
cggcggcggacggtcccgctgtcctgcctggccggggccgcactgcgccgcccgccgcccgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgccccccatgataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccg

SEQ ID NO: 107802 - DNA, 620 bp, Homo sapiens
  Payload ID: 1165
  Gene Symbol: ANKRD9
  Gene Name: ankyrin repeat domain 9
  ENST ID: ENST00000557902
  CDS Start-End: 305-620
gggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagagataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccg

SEQ ID NO: 107803 - DNA, 1444 bp, Homo sapiens
  Payload ID: 1165
  Gene Symbol: ANKRD9
  Gene Name: ankyrin repeat domain 9
  Uniprot ID: Q96BM1
  ENST ID: ENST00000559651
  CDS Start-End: 397-1350
ggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctatctcctcccaggagctaacgtgtaagcaaacatgtttggatagagggctggtgccacgccccaggctcaccccgcccgcacagccgtcgtccacccctcccctttcttacagataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcacaa

SEQ ID NO: 107804 - DNA, 2063 bp, Homo sapiens
  Payload ID: 1166
  Gene Symbol: ANKRA2
  Gene Name: ankyrin repeat, family A (RFXANK-like), 2
  Uniprot ID: Q9H9E1
  ENST ID: ENST00000296785
  CDS Start-End: 660-1601
ggcggggcgatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaataaaaaagtgcacagtgtgattgtttacaaaatgatattataaataaataaaatacttcttctgtca

SEQ ID NO: 107805 - DNA, 902 bp, Homo sapiens
  Payload ID: 1166
  Gene Symbol: ANKRA2
  Gene Name: ankyrin repeat, family A (RFXANK-like), 2
  ENST ID: ENST00000504641
  CDS Start-End: 370-902
cctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgt

SEQ ID NO: 107806 - DNA, 1865 bp, Homo sapiens
  Payload ID: 1167
  Gene Symbol: ASZ1
  Gene Name: ankyrin repeat, SAM and basic leucine zipper domain containing 1
  Uniprot ID: Q8WWH4
  ENST ID: ENST00000284629
  CDS Start-End: 64-1491
ggtgcgcatgcgcccggagagctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaaaatattgacaacagattctgatagagaaaaagatcacatttttagttcatatacagcatttggagatctggaagtatttttacatggtcttggacttgaacatatgacagatttactaaaggaaagggatataacgttaagacatcttttgaccatgagggaagatgaatttacaaagaatggaattaccagtaaagaccagcagaaaattctggctgctcttaaagaactacaggtagaagagatacaatttggagagctatctgaagagacaaagttggaaatcagtggtgatgagttcctcaactttcttctcaaattaaataaacagtgtggccatttaataacagctgtacagaatgttattactgagttacctgtaaattctcaaaagataacactggaatgggcttctccccagaattttacttcagtttgtgaagaattggttaataatgttgaagatttgagtgaaaaggtctgcaaactaaaagacctaattcaaaagttgcaaaatgaacgggaaaatgatccaactcatatacaattaagggaagaagtatctacatggaatagtagaattttgaagaggacagctattaccatatgcggattcggttttcttcttttcatttgcaagctaactttccagaggaaataatccaaatatttgttttaagttatatatacacatcttattgaaccatccaaaaatcattgcttttaactgtttgcagcacaatataactttacattctttgccaatattccataggaaaaattttgacaatgtggagtttttttttaaaaagtggtttgttactttgacttataaatacaatttgttatgtttatgttaattgtgattaggtagtaaagtataagtaattttttggtttgatcgtatctaaatcacattcaaaattaaagttatatctaatatctttgacattttttaaagtgtgttcatttgtcagtgaatcgtacaggatttgtaaagtgttcataaattgagctttcttttgtttctttttt

SEQ ID NO: 107807 - DNA, 1423 bp, Homo sapiens
  Payload ID: 1167
  Gene Symbol: ASZ1
  Gene Name: ankyrin repeat, SAM and basic leucine zipper domain containing 1
  ENST ID: ENST00000450714
  CDS Start-End: 48-494
gagagctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaaaatattgacaacagattctgatagagaaaaagatcacatttttagttcatatacagcatttggagatctggaagtatttttacatggtcttggacttgaacatatgacagatttactaaaggaaagggatataacgttaagacatcttttgaccatgagggaagatgaatttacaaagaatggaattaccagtaaagaccagcagaaaattctggctgctcttaaagaactacaggtagaagagatacaatttggagagctatctgaagagacaaagttggaaatcagtggtgatgagttcctcaactttcttctcaaattaaataaacagtgtggccatttaataacagctgtacagaatgttattactgagttacctgtaaattctcaaaagataacactggaatgggcttctccccagaattttacttcagtttgtgaagaattggttaataatgttgaagatttgagtgaaaaggtctgcaaactaaaagacctaattcaaaagttgcaaaatgaacgggaaaatgatccaactcatatacaattaagggaagaagtatctacatggaatagtagaattttgaagaggacagctattaccatatgcggattcggttttcttcttttcatttgcaagctaactttccagaggaaataatccaaatatttgttttaagttatatatacacatcttattgaaccatccaaaaatcattgc

SEQ ID NO: 107808 - DNA, 242 bp, Homo sapiens
  Payload ID: 1167
  Gene Symbol: ASZ1
  Gene Name: ankyrin repeat, SAM and basic leucine zipper domain containing 1
  ENST ID: ENST00000428663
  CDS Start-End: 109-242
tctacacttcatagcggggaagtgttttgatggtctgaagcttctaaatctaagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtcct

SEQ ID NO: 107809 - DNA, 2426 bp, Homo sapiens
  Payload ID: 1168
  Gene Symbol: ANKFN1
  Gene Name: ankyrin-repeat and fibronectin type III domain containing 1
  Uniprot ID: Q8N957
  ENST ID: ENST00000318698
  CDS Start-End: 36-2327
ctctttcaactcaagagctcagtcctgtgtctctcatggaggcgtctctaaccaggaggctactctttaaagacaggcattttacttgcagcaaaataataggaaggagattcgcttgctttgcacagaggctgagccacaggagaaagcaaagccaatgtgatttattgaatgaaagcactggacaattaccaacaacttgttcctctgctgcctcgaacagcataaactggaattgtcgtgtgaaaatgacgcaacaaatgcaaaatttacatctctgtcagtcaaaaaaacatagtgctccctcatctcccaacgcagccaaacgcctgtacaggaacctctctgagaaactgaaagggagccactcttccttcgatgaggcctattttaggacaagaactgatcggctgagtctcaggaagacctcggtgaatttccagggcaatgaagccatgtttgaggcagtcgaacagcaggacatggatgctgtgcagatcctcctgtatcagtacacaccagaagaacttgacctcaacacacctaacagcgagggcttgacacccctggatattgccatcatgaccaacaatgtgcccattgcaaggattcttctgaggacaggggcccgagaaagtccacactttgtcagcctggaaagccgagcaatgcacctcaacacactggtccaggaagcccaggagagggtgagtgaactgtctgcccaggtggagaatgaaggattcactctggacaacacagagaaagagaagcagctgaaagcttgggagtggaggtatcggctctacagacgcatgaaaacaggctttgagcatgccagagcccctgagatgccaaccaatgtctgtctcatggtaaccagcagcacatcactcactgtcagcttccaagagcctcttagcgtcaatgcagctgtagtaaccaggtataaagtggaatggagtatgtccgaagacttttctcctttggctggagaaatcatcatggataatctgcagactctgagatgcacaatcacaggacttacaatgggccaacagtattttgttcaagtctcggcttacaatatgaaaggatggggacctgctcagaccacgacaccggcatgtgcctctccttctaactggaaagactatgacgacagagagcccagacacaagggacagagtgaagttttggaaggtctgctgcagcaggtccgagcccttcatcagcattacagttgccgggaaagcacaaaattacaaaccacaggccgcaagcagtcagtctcaagaagcctgaaacacctgttccattcctcgaacaagtttgtgaagaccttaaaacggggactctacatagccgttatattttattacaaagacaatatcttagtcaccaatgaagatcaagtaccaattgttgaaatagatgactctcacaccagttctattacacaagattttctgtggttcacgaagctgtcttgtatgtgggaagatataaggtggctgaggcaaagcataccaatatcctcatcctcatccacagtgctgcaaactcggcagaagatgctcgcagcaacagcacagctacagaatttacttgggacacacaacttgggaagagtttactatgagcccattaaagatcgacatggaaacatactcatagtcaccatcagggaggtggagatgctttattcattttttaatggcaaatggatgcagatctcaaagctgcaaagccagagaaagtctctatcaacacctgaggagccaacagctttagacattctactgataaccatccaggatattctatcctatcacaaaaggagtcatcagcgtctctttcctggattatatctgggttacctaaagctctgtagctctgtggatcaaatcaaagttcttgttacccaaaagttgcccaacattctctgccacgtgaagatccgtgaaaacaataatatttctagagaggaatgggaatggatccaaaagctttctggctctgaatctatggaaagtgtggatcatacttctgactgccccatgcaattgttcttctacgagctccagatggcagtgaaagctctccttcagcagatcaatatacctctacaccaggcaaggaacttccgcctctacacacaggaggtgttggaaatgggtcacaatgtgtcctttcttctcctgctccctgcctcagacgacgtctgtacagccccaggacagaataatccttacaccccacactcagggtttcttaacctccctcttcagatgtttgaacttggtatagtagcttgtttcacctagaaatattaacccagcctccttataataaaatcacaaagttatatctgttcccccttgtcccagtggagggtcaataaatcacatgatggctttggcaac

SEQ ID NO: 107810 - DNA, 3840 bp, Homo sapiens
  Payload ID: 1168
  Gene Symbol: ANKFN1
  Gene Name: ankyrin-repeat and fibronectin type III domain containing 1
  ENST ID: ENST00000566473
  CDS Start-End: 1-3450
atggaggcgtctctaaccaggaggctactctttaaagacaggcattttacttgcagcaaaataataggaaggagattcgcttgctttgcacagaggctgagccacaggagaaagcaaagccaatgtgatttattgaatgaaagcactggacaattaccaacaacttgttcctctgctgcctcgaacagcataaactggaattgtcgtgtgaaaatgacgcaacaaatgcaaaatttacatctctgtcagtcaaaaaaacatagtgctccctcatctcccaacgcagccaaacgcctgtacaggaacctctctgagaaactgaaagggagccactcttccttcgatgaggcctattttaggacaagaactgatcggctgagtctcaggaagacctcggtgaatttccagggcaatgaagccatgtttgaggcagtcgaacagcaggacatggatgctgtgcagatcctcctgtatcagtacacaccagaagaacttgacctcaacacacctaacagcgagggcttgacacccctggatattgccatcatgaccaacaatgtgcccattgcaaggattcttctgaggacaggggcccgagaaagtccacactttgtcagcctggaaagccgagcaatgcacctcaacacactggtccaggaagcccaggagagggtgagtgaactgtctgcccaggtggagaatgaaggattcactctggacaacacagagaaagagaagcagctgaaagcttgggagtggaggtatcggctctacagacgcatgaaaacaggctttgagcatgccagagcccctgagatgccaaccaatgtctgtctcatggtaaccagcagcacatcactcactgtcagcttccaagagcctcttagcgtcaatgcagctgtagtaaccaggtataaagtggaatggagtatgtccgaagacttttctcctttggctggagaaatcatcatggataatctgcagactctgagatgcacaatcacaggacttacaatgggccaacagtattttgttcaagtctcggcttacaatatgaaaggatggggacctgctcagaccacgacaccggcatgtgcctctccttctaactggaaagactatgacgacagagagcccagacacaagggacagagtgaagttttggaaggtctgctgcagcaggtccgagcccttcatcagcattacagttgccgggaaagcacaaaattacaaaccacaggccgcaagcagtcagtctcaagaagcctgaaacacctgttccattcctcgaacaagtttgtgaagaccttaaaacggggactctacatagccgttatattttattacaaagacaatatcttagtcaccaatgaagatcaagtaccaattgttgaaatagatgactctcacaccagttctattacacaagattttctgtggttcacgaagctgtcttgtatgtgggaagatataaggtggctgaggcaaagcataccaatatcctcatcctcatccacagtgctgcaaactcggcagaagatgctcgcagcaacagcacagctacagaatttacttgggacacacaacttgggaagagtttactatgagcccattaaagatcgacatggaaacatactcatagtcaccatcagggaggtggagatgctttattcattttttaatggcaaatggatgcagatctcaaagctgcaaagccagagaaagtctctatcaacacctgaggagccaacagctttagacattctactgataaccatccaggatattctatcctatcacaaaaggagtcatcagcgtctctttcctggattatatctgggttacctaaagctctgtagctctgtggatcaaatcaaagttcttgttacccaaaagttgcccaacattctctgccacgtgaagatccgtgaaaacaataatatttctagagaggaatgggaatggatccaaaagctttctggctctgaatctatggaaagtgtggatcatacttctgactgccccatgcaattgttcttctacgagctccagatggcagtgaaagctctccttcagcagatcaatatacctctacaccaggcaaggaacttccgcctctacacacaggaggtgttggaaatgggtcacaatgtgtcctttcttctcctgctccctgcctcagacgacgtctgtacagccccaggacagaataatccttacaccccacactcagggtttcttaacctccctcttcagatgtttgaacttgttcatttttgcagctacagagagaaatttattagtctgtattgccgcctttctgctgttgtggagctggattctctgaacacccaacagtccctcagggaagcaatctcagacagcgaggttgcagctgccaaacaaagacaccagcaagttttagatttcattcagcaaatagatgaagtctggcgtgaaatgagatggatcatggatgctctacagtatgcaagatacaaacaaccagtttctggcttgcccatcactaagctgatagacccctcagatgagcagagcctaaagaagatcaattctacatcatcatcacatatagactgtcttccatccccacccccatccccagagatgcacagaagaaagacagtgagtgattcacagccctgctctgatgaagaagcctgctcagaagtcttcctccccaccaacagtgactacgactccagcgatgccctgagccccagagacctggacctggtctacctatcatctcacgacattgcgcagcagacccttagcggcctaagcggcagcgcccccgacgtcctgcaagtgcacgacgtgaaaacccctctggggccgggccaggatccccagggcgagggcccaaatcccgatcactcatgtgccgagtttctccatagcctgaccctcacggggttcacacccaagaaccacgccaagactgtgtccggtgggcggcccccgctaggcttcctgggaaagcggaagccaggcaagcacccccactatggcggcttcagccgccatcatcgctggttgcgcatccacagcgagacccagtcgctatcgctctctgagggcatttatacacagcacctgtcccaggcctgtggtctggcccaggagcccaaggaggccaagcgggccggccctgcccttgatgatcccaggggcctaactctggcccacgctgccagccttcctgaggagcggaacagcagtctccaggacgcgaggccttccgtccgccgcctctacgtggagccctacgcagcggccgtggtggcccaggacgaaaaaccatgggcaagcttgagcccgccctctggaggccgcatcaccctgcccagccccactggccccgatgtgagtcaggagggccccaccgcctctcccatgtcagaaatactcagcagcatgctttagggaggcccatcccggctgtccacccctccatggctgctacctgcgttttacatcacccttacccccatcctgccccactgtgtacccactcattttcaagcgttttgaatgttataaatacaaaggttacaagttcaaggtcctctttttttggaacagagtggtgggtggaggccagagttgccagtgccattcccacttcagcctagaaagggcatgggggagttgtgtcaacatggaatacgacatacagtgactcaaacatgccaccctgttggtggcacctatgactgaagctggccatcccaaagagagaccctctgttctgcagctggttctgtaatctgacccctagtttagggctctttcatgaatttgtgattgatgaag

SEQ ID NO: 107811 - DNA, 665 bp, Homo sapiens
  Payload ID: 1168
  Gene Symbol: ANKFN1
  Gene Name: ankyrin-repeat and fibronectin type III domain containing 1
  ENST ID: ENST00000572945
  CDS Start-End: 147-665
atttcctgggctggccacagagccagatgcctgcagggttctctctttgccagcagctcttcaaagacttgtgagcccactcagccctccagagacactcttcactgcaaagcctcaggcagcctagccaggggaccctggagctgatgccacctggaatccctaccaagtgtgcaaagcagccacattctgggacagctggattggaggagggagcagaggctgagaggctactctttaaagacaggcattttacttgcagcaaaataataggaaggagattcgcttgctttgcacagaggctgagccacaggagaaagcaaagccaatgtgatttattgaatgaaagcactggacaattaccaacaacttgttcctctgctgcctcgaacagcataaactggaattgtcgtgtgaaaatgacgcaacaaatgcaaaatttacatctctgtcagtcaaaaaaacatagtgctccctcatctcccaacgcagccaaacgcctgtacaggaacctctctgagaaactgaaagggagccactcttccttcgatgaggcctattttaggacaagaactgatcggctgagtctcaggaagacctcggtgaatttccagggcaatgaagccatgtttgaggcagtcgaacagcaggacatggatgctgtg

SEQ ID NO: 107812 - DNA, 1509 bp, Homo sapiens
  Payload ID: 1169
  Gene Symbol: ANXA1
  Gene Name: annexin A1
  Uniprot ID: P04083
  ENST ID: ENST00000257497
  CDS Start-End: 183-1223
agctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 107813 - DNA, 2209 bp, Homo sapiens
  Payload ID: 1169
  Gene Symbol: ANXA1
  Gene Name: annexin A1
  Uniprot ID: P04083
  ENST ID: ENST00000376911
  CDS Start-End: 883-1923
aaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 107814 - DNA, 799 bp, Homo sapiens
  Payload ID: 1169
  Gene Symbol: ANXA1
  Gene Name: annexin A1
  ENST ID: ENST00000456643
  CDS Start-End: 187-799
agtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtg

SEQ ID NO: 107815 - DNA, 526 bp, Homo sapiens
  Payload ID: 1169
  Gene Symbol: ANXA1
  Gene Name: annexin A1
  ENST ID: ENST00000415424
  CDS Start-End: 181-526
tttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccag

SEQ ID NO: 107816 - DNA, 1417 bp, Homo sapiens
  Payload ID: 1170
  Gene Symbol: ANXA10
  Gene Name: annexin A10
  Uniprot ID: Q9UJ72
  ENST ID: ENST00000359299
  CDS Start-End: 187-1161
acagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatagaaaaa

SEQ ID NO: 107817 - DNA, 1341 bp, Homo sapiens
  Payload ID: 1170
  Gene Symbol: ANXA10
  Gene Name: annexin A10
  ENST ID: ENST00000617524
  CDS Start-End: 127-1098
ggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggcagctttcggatcacttcaaagatgtgatggctggctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatgg

SEQ ID NO: 107818 - DNA, 2526 bp, Homo sapiens
  Payload ID: 1171
  Gene Symbol: ANXA11
  Gene Name: annexin A11
  Uniprot ID: P50995
  ENST ID: ENST00000265447
  CDS Start-End: 379-1797
agatctaaccatgagctaccctggctatcccccgcccccaggtggctacccaccagctgcaccaggttggctggcactggcctgggttctctctctatagtagaaatcctgccatccagatcctgccactgccacctttgctagcacagctgagcagcctctgagcagcaagagaggaggaggcaggaaatttagggaaggttcttcctggagggtctggagccctggagatgaagagccgatccgaagctgccatgtagaggaaagcatctaacaggccagaggccccatgatgatgtcgaatgcccatcgggcacccagctgagccctgcaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtc

SEQ ID NO: 107819 - DNA, 6720 bp, Homo sapiens
  Payload ID: 1171
  Gene Symbol: ANXA11
  Gene Name: annexin A11
  Uniprot ID: P50995
  ENST ID: ENST00000372231
  CDS Start-End: 239-1756
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 107820 - DNA, 6965 bp, Homo sapiens
  Payload ID: 1171
  Gene Symbol: ANXA11
  Gene Name: annexin A11
  Uniprot ID: P50995
  ENST ID: ENST00000438331
  CDS Start-End: 484-2001
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccagggattattggacctgcctggtttaaactattgtcttagttaattttgtgctgctctaacaaaatatcacagactgagtaatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 107821 - DNA, 2534 bp, Homo sapiens
  Payload ID: 1171
  Gene Symbol: ANXA11
  Gene Name: annexin A11
  Uniprot ID: P50995
  ENST ID: ENST00000422982
  CDS Start-End: 288-1805
gcactgcctctggcacctggggcagccgcgcccgcggagttttccgcccggcgctgacggctgctgcgcccgcggctccccagtgccccgagtgccccgcgggccccgcgagcgggagtgggacccagcccctaggcagaacccaggcgccgcgcccgggacgcccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccagtttggaagccgaggcaccatcactgatgctcccggctttgaccccctgcgagatgccgaggtcctgcggaaggccatgaaaggcttcgggacggatgagcaggccatcattgactgcctggggagtcgctccaacaagcagcggcagcagatcctactttccttcaagacggcttacggcaaggatttgatcaaagatctgaaatctgaactgtcaggaaactttgagaagacaatcttggctctgatgaagaccccagtcctctttgacatttatgagataaaggaagccatcaagggggttggcactgatgaagcctgcctgattgagatcctcgcttcccgcagcaatgagcacatccgagaattaaacagagcctacaaagcagaattcaaaaagaccctggaagaggccattcgaagcgacacatcagggcacttccagcggctcctcatctctctctctcagggaaaccgtgatgaaagcacaaacgtggacatgtcactcgcccagagagatgcccaggagctgtatgcggccggggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtc

SEQ ID NO: 107822 - DNA, 750 bp, Homo sapiens
  Payload ID: 1171
  Gene Symbol: ANXA11
  Gene Name: annexin A11
  ENST ID: ENST00000447489
  CDS Start-End: 1-446
gggagaaccgcctgggaacagacgagtccaagttcaatgcggttctgtgctcccggagccgggcccacctggtagcagttttcaatgagtaccagagaatgacaggccgggacattgagaagagcatctgccgggagatgtccggggacctggaggagggcatgctggccgtggtgaaatgtctcaagaataccccagccttctttgcggagaggctcaacaaggccatgaggggggcaggaacaaaggaccggaccctgattcgcatcatggtgtctcgcagcgagaccgacctcctggacatcagatcagagtataagcggatgtacggcaagtcgctgtaccacgacatctcgagtatctcctgcatgccagcaagctatggacatctggaagaagccacatgccttgccctcaagttgcttagggtggaaggaaatgattagaaatgagccaagccgagcctgcactcttagaggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatcc

SEQ ID NO: 107823 - DNA, 610 bp, Homo sapiens
  Payload ID: 1171
  Gene Symbol: ANXA11
  Gene Name: annexin A11
  ENST ID: ENST00000437799
  CDS Start-End: 161-610
agtgaactggtctgcgacaagcagggcagatgcagcagtttcttctgcagggtcccagttgtggtggtggctgccctttcaagaagctgggtcccacgggccagcaggggctctcaggcagagcctgaatgtgctttcgtcttctcttccagatctaaccatgagctaccctggctatcccccgcccccaggtggctacccaccagctgcaccaggtggtggtccctggggaggtgctgcctaccctcctccgcccagcatgccccccatcgggctggataacgtggccacctatgcggggcagttcaaccaggactatctctcgggaatggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtg

SEQ ID NO: 107824 - DNA, 1588 bp, Homo sapiens
  Payload ID: 1172
  Gene Symbol: ANXA13
  Gene Name: annexin A13
  Uniprot ID: P27216
  ENST ID: ENST00000262219
  CDS Start-End: 69-1142
gtaaactttgcctgtaggaggactgatctcttgatgaaatacagaaaaaccatctcagaaaaaggaaaatgggcaatcgtcatagccagtcgtacaccctctcagaaggcagtcaacagttgcctaaaggggactcccaaccctcgacagtcgtgcagcctctcagccacccatcacggaatggagagccagaggccccacagcctgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccgcctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctcta

SEQ ID NO: 107825 - DNA, 1469 bp, Homo sapiens
  Payload ID: 1172
  Gene Symbol: ANXA13
  Gene Name: annexin A13
  Uniprot ID: P27216
  ENST ID: ENST00000419625
  CDS Start-End: 74-1024
ctgttgtaaactttgcctgtaggaggactgatctcttgatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccgcctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctct

SEQ ID NO: 107826 - DNA, 563 bp, Homo sapiens
  Payload ID: 1172
  Gene Symbol: ANXA13
  Gene Name: annexin A13
  ENST ID: ENST00000520519
  CDS Start-End: 225-563
agatagttcaggcaccaagagaactccatggcctcacatagctccagattagcagcctcaaggaaaatctcttctttctctaagtatctgtaagatgtcagggaagaattccagttggcttgggtcatggacctaccctgtgaataatcatagctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggt

SEQ ID NO: 107827 - DNA, 1444 bp, Homo sapiens
  Payload ID: 1173
  Gene Symbol: ANXA2
  Gene Name: annexin A2
  Uniprot ID: P07355
  ENST ID: ENST00000332680
  CDS Start-End: 73-1146
ctcagcatttggggacgctctcagctctcggcgcacggcccaggtaagcggggcgcgccctgcccgcccgcgatgggccgccagctagcggggtgtggagacgctgggaagaaggcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaa

SEQ ID NO: 107828 - DNA, 1676 bp, Homo sapiens
  Payload ID: 1173
  Gene Symbol: ANXA2
  Gene Name: annexin A2
  Uniprot ID: P07355
  ENST ID: ENST00000396024
  CDS Start-End: 161-1180
gctcagcatttggggacgctctcagctctcggcgcacggcccagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtcacacaa

SEQ ID NO: 107829 - DNA, 1435 bp, Homo sapiens
  Payload ID: 1173
  Gene Symbol: ANXA2
  Gene Name: annexin A2
  Uniprot ID: P07355
  ENST ID: ENST00000451270
  CDS Start-End: 113-1132
gcctcgcctagggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgt

SEQ ID NO: 107830 - DNA, 1444 bp, Homo sapiens
  Payload ID: 1173
  Gene Symbol: ANXA2
  Gene Name: annexin A2
  Uniprot ID: P07355
  ENST ID: ENST00000421017
  CDS Start-End: 137-1156
gctcagcatttggggacgctctcagctctcggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgt

SEQ ID NO: 107831 - DNA, 663 bp, Homo sapiens
  Payload ID: 1173
  Gene Symbol: ANXA2
  Gene Name: annexin A2
  ENST ID: ENST00000560468
  CDS Start-End: 333-663
gctcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacg

SEQ ID NO: 107832 - DNA, 834 bp, Homo sapiens
  Payload ID: 1173
  Gene Symbol: ANXA2
  Gene Name: annexin A2
  ENST ID: ENST00000561022
  CDS Start-End: 56-265
gctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgccagacctgagccacgtagctatcaaacactggaaaaggagtccttggtgcctttctaattgtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatg

SEQ ID NO: 107833 - DNA, 812 bp, Homo sapiens
  Payload ID: 1173
  Gene Symbol: ANXA2
  Gene Name: annexin A2
  ENST ID: ENST00000557906
  CDS Start-End: 285-812
gctcagcatttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 107834 - DNA, 718 bp, Homo sapiens
  Payload ID: 1173
  Gene Symbol: ANXA2
  Gene Name: annexin A2
  ENST ID: ENST00000560165
  CDS Start-End: 191-718
ctctcagctctcggcgcacggcccaggtaagcggggcgcgccctgcccgcccgcgatgggccgccagctagcggggtgtggagacgctgggaagaagggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 107835 - DNA, 369 bp, Homo sapiens
  Payload ID: 1173
  Gene Symbol: ANXA2
  Gene Name: annexin A2
  ENST ID: ENST00000557904
  CDS Start-End: 127-369
attccagcaggaaaacaggatggaggaaggtacaaagcatgaatgagcctggcctgtccagcagtggcacatggagcggtgaagagtgaagatgtgggggaatgaggctgcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaag

SEQ ID NO: 107836 - DNA, 513 bp, Homo sapiens
  Payload ID: 1173
  Gene Symbol: ANXA2
  Gene Name: annexin A2
  ENST ID: ENST00000558558
  CDS Start-End: 111-513
gctcagcatttggggacgctctcagctctcggcgcacggcccagagacgctcttctggctcttccgtgacgcattacaacagccatccaggccggtccacttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctcca

SEQ ID NO: 107837 - DNA, 755 bp, Homo sapiens
  Payload ID: 1173
  Gene Symbol: ANXA2
  Gene Name: annexin A2
  ENST ID: ENST00000559467
  CDS Start-End: 399-755
tttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatgatggagcctggctctgtcacccagcctggagtgtagtcgcacgatctctcctcactgtagcctccgcctcccaggttcaagtgattctccagcctcaccctcccgagtagctgggattacagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaag

SEQ ID NO: 107838 - DNA, 780 bp, Homo sapiens
  Payload ID: 1173
  Gene Symbol: ANXA2
  Gene Name: annexin A2
  ENST ID: ENST00000558985
  CDS Start-End: 354-780
gggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatgtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctgg

SEQ ID NO: 107839 - DNA, 561 bp, Homo sapiens
  Payload ID: 1173
  Gene Symbol: ANXA2
  Gene Name: annexin A2
  ENST ID: ENST00000559725
  CDS Start-End: 427-561
aggccagccggctctgctcagcatttggggacgctctcagctctcggcgcacggcccagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatgtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggac

SEQ ID NO: 107840 - DNA, 828 bp, Homo sapiens
  Payload ID: 1173
  Gene Symbol: ANXA2
  Gene Name: annexin A2
  ENST ID: ENST00000558503
  CDS Start-End: 230-628
gggacgctctcagctctcggcgcacggcccaggttatcttgtagcatagcaacttcggatttcactctacccggagagtttcccgcttggttgaacacattggcctcaggaagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggtaaatgcatgggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcggg

SEQ ID NO: 107841 - DNA, 744 bp, Homo sapiens
  Payload ID: 1173
  Gene Symbol: ANXA2
  Gene Name: annexin A2
  ENST ID: ENST00000559176
  CDS Start-End: 1-744
gtaaccagattctaatctggtgtcagcaatgccaagaaaattctccaatatcaagtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagg

SEQ ID NO: 107842 - DNA, 777 bp, Homo sapiens
  Payload ID: 1173
  Gene Symbol: ANXA2
  Gene Name: annexin A2
  ENST ID: ENST00000560367
  CDS Start-End: 96-777
gttatcttgtagcatagcaacttcggatttcactctacccggagagtttcccgcttggttgaacacattggcctcaggaaggtacttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaag

SEQ ID NO: 107843 - DNA, 521 bp, Homo sapiens
  Payload ID: 1173
  Gene Symbol: ANXA2
  Gene Name: annexin A2
  ENST ID: ENST00000559370
  CDS Start-End: 326-521
gctcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatgatggagcctggctctgtcacccagcctggagtgtagtcgcacgatctctcctcactgtagcctccgcctcccaggttcaagtgattctccagcctcaccctcccgagtagctgggattacagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatg

SEQ ID NO: 107844 - DNA, 594 bp, Homo sapiens
  Payload ID: 1173
  Gene Symbol: ANXA2
  Gene Name: annexin A2
  ENST ID: ENST00000560389
  CDS Start-End: 67-594
atggctgtgatctttctctctgtgtcttaatcacttggaataaagaaccattgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 107845 - DNA, 669 bp, Homo sapiens
  Payload ID: 1173
  Gene Symbol: ANXA2
  Gene Name: annexin A2
  ENST ID: ENST00000559350
  CDS Start-End: 222-669
gaagggaagagagctcaaaggtcctgcagggtggaagtctgcatttcacagttttataagtgtcttttgtatcctttaatatagtgcaggctcagcgtatgcttgggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaa

SEQ ID NO: 107846 - DNA, 558 bp, Homo sapiens
  Payload ID: 1173
  Gene Symbol: ANXA2
  Gene Name: annexin A2
  ENST ID: ENST00000559956
  CDS Start-End: 202-558
tcagcatttggggacgctctcagctctcggcgcacggcccagagacgctcttctggctcttccgtgacgcattacaacagccatccaggccggtccagttacgctgcattccttcctccttcccatttcggcggacctgcatccagctagagactagcagattgaatcgatattcattaagttaggaatgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaag

SEQ ID NO: 107847 - DNA, 560 bp, Homo sapiens
  Payload ID: 1173
  Gene Symbol: ANXA2
  Gene Name: annexin A2
  ENST ID: ENST00000558986
  CDS Start-End: 161-560
actctcagtgtgtcacagaggcacgaagggaagagagctcaaagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgct

SEQ ID NO: 107848 - DNA, 733 bp, Homo sapiens
  Payload ID: 1173
  Gene Symbol: ANXA2
  Gene Name: annexin A2
  ENST ID: ENST00000557986
  CDS Start-End: 720-733
ggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatgcggccaggccctgttgaaaatacaatatgtgggccataaaacactgaaattgagttgcagacttgaaggcctggatttcccaaccctgaaagtgcttcatgccaagtgacatcattcttcctgccggtctctttccacccactccaaccccagatcaggataccagcagagagaggctgtgagagcatgaagctgcaacaagtcagtagggagcaaacaaatattgattcagatcaggccacagaagagacaagctggagcaagtgctgtgtgtccctcctgctcagtttgatcgaggtcactgggccgaattccaggaattctggggaatgagttggccctg

SEQ ID NO: 107849 - DNA, 2339 bp, Homo sapiens
  Payload ID: 1173
  Gene Symbol: ANXA2
  Gene Name: annexin A2
  ENST ID: ENST00000560014
  CDS Start-End: 1023-1715
acatactctcgccaaaccagttttatgaaaatatttagactaaacaaagtgaagagaatagaaagctgtatttgcatgtgtgcagtttccttgatcaaagaatattaagcaaaaagagaccaaagcaggagtcactgcaatttaaatgtcgttcctgtctatttcaggacgcagctctactctgttttctttattcttggggtgattatgttgatgacctgtcttgtctctgttgagataaatttaccaccaattgagcactccttattggcagggattgggtgtatcaattccgagaactgtatgattgcaaaggtggaaagccaattcatcaggctattgttttgctgccccattaagtatattaactggaagatgacttcatttcaaccatttcaaatcttaaatacaacagattcagtcctttatggaatgagttaaggtcagaaaatctgtccatcgtctttctcataaatactttaatatcttccaagtatcattggactaagaaagtaattatgggtaataataaagattccaattaagaattagggcaacatgaaaatgctactaatttcgattcacatcgtagctttcaggtccttctcaatatgtttaattacttgtgagaaatacagaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgaatcgctgtgcttcagagtaaaggagagcctcttcataaagactttttgttgtactttttttccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaaggtggtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 107850 - DNA, 802 bp, Homo sapiens
  Payload ID: 1173
  Gene Symbol: ANXA2
  Gene Name: annexin A2
  ENST ID: ENST00000559780
  CDS Start-End: 363-802
gggacgctctcagctctcggcgcacggcccaggcggccaggccctgttgaaaatacaatatgtgggccataaaacactgaaattgagttgcagacttgaaggcctggatttcccaaccctgaaagtgcttcatgccaagtgacatcattcttcctgccggtctctttccacccactccaaccccagatcaggataccagcagagagaggctgtgagagcatgaagctgcaacaagtcagtagggagcaaacaaatattgattcagatcaggccacagaagagacaagctggagcaagtgctgtgtgtccctcctgctcagtttgatcgaggtcactgggccgaattccaggaattctggggaatgagttggccctgtgactcagtcattaatcaagaccataaaaccaaggagaagaatatctgctttcaaaaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaa

SEQ ID NO: 107851 - DNA, 665 bp, Homo sapiens
  Payload ID: 1173
  Gene Symbol: ANXA2
  Gene Name: annexin A2
  ENST ID: ENST00000560466
  CDS Start-End: 248-665
gctcagcatttggggacgctctcagctctcggcgcacggcccaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcc

SEQ ID NO: 107852 - DNA, 878 bp, Homo sapiens
  Payload ID: 1173
  Gene Symbol: ANXA2
  Gene Name: annexin A2
  ENST ID: ENST00000559818
  CDS Start-End: 110-878
actgcctgctacgaggccgcgcagagatgccccaggcgcggagagaagcggagcacagccgtgctagggacaggggcgccaccctgggcgggactgagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcc

SEQ ID NO: 107853 - DNA, 564 bp, Homo sapiens
  Payload ID: 1173
  Gene Symbol: ANXA2
  Gene Name: annexin A2
  ENST ID: ENST00000559113
  CDS Start-End: 388-564
gctcagcatttggggacgctctcagctctcggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatgtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaag

SEQ ID NO: 107854 - DNA, 543 bp, Homo sapiens
  Payload ID: 1173
  Gene Symbol: ANXA2
  Gene Name: annexin A2
  ENST ID: ENST00000558998
  CDS Start-End: 307-543
cagctctcggcgcacggcccaggttatcttgtagcatagcaacttcggatttcactctacccggagagtttcccgcttggttgaacacattggcctcaggaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgg

SEQ ID NO: 107855 - DNA, 557 bp, Homo sapiens
  Payload ID: 1173
  Gene Symbol: ANXA2
  Gene Name: annexin A2
  ENST ID: ENST00000558169
  CDS Start-End: 416-557
ctgctcagcatttggggacgctctcagctctcggcgcacggcccaggttatcttgtagcatagcaacttcggatttcactctacccggagagtttcccgcttggttgaacacattggcctcaggaagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaaga

SEQ ID NO: 107856 - DNA, 580 bp, Homo sapiens
  Payload ID: 1173
  Gene Symbol: ANXA2
  Gene Name: annexin A2
  ENST ID: ENST00000558132
  CDS Start-End: 56-580
gctcagcatttggggacgctctcagctctcggcgcacggcccagcttccttcaaaatgtctactgttcacgaaatcctgtgcaagctcagcttggagggtgatgaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatg

SEQ ID NO: 107857 - DNA, 2234 bp, Homo sapiens
  Payload ID: 1174
  Gene Symbol: ANXA2R
  Gene Name: annexin A2 receptor
  Uniprot ID: Q3ZCQ2
  ENST ID: ENST00000314890
  CDS Start-End: 1421-2002
gggtgccccccaccatccccagcccgcagcataatcggtgaagggagcctgcggtttctccgccgcgccttcgcccgttgcgtcctgcgaagccagtggaatcggtggtcacaaggaaattatgacaggagcaacctgcaggggtttagatctgacagaaatattctaatggtaggcattgcatcgcttagccatatttgtaatttcttctttgtagggttggttctctgtaacttttgcttaccttaaaattatttttgtgtcttgctctgaggacaatgttaccgatgtgtttttcatttttacttgcatttcagactttcattattttaaattatgtattttttttttcttctaattttgagcgtctcagattcgtgcttcttgactttcattctctcaggagccggggagccgagctcggtcttagcctcgctggtatcaggttccgggttctgtctggaggctccgcttcctatgcagagctggcggttttgtatcagcacgtttgccagtggcgcccactgggcgttttctcagttgctgcacccaacgtgacatttcccgttcgcggggtccttaggttctcagtgctgtcactttttcgctcctacaaccgctagtatctcctaggaacttcctgaaccccgttttgccgtgcagaacggtgattgcaccgagccgctgttcgcactagtaattgtgtggtaccattagccggcgctttttctgtcacaacccattaaaacgggttaaaacatattaaacctatcaaacacattgaacggattaaaacacattaaatgccgcaacacatttttctggtacaacacattgaaacagagttggttcattcctccaaacaggttgtttaggtgtggaagcaccgctcttagttctaagagcatgctgtttctctttagcagcaccctttacggcgccaaaacggatatttgtttggcaataccagcgctatccgctaggtgccggcgcttgctaagttcaacgcgccagtttctcgtttgcaaggtggttagggcagagccctagcagacagttttccggtggcagcaacgctcatttcccggaaacgggtggttcttggcccttgcgcgctcttgaatacctgcgttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttcattgctggttgtcagtttttaaattctctttttcccttatgtttctttcttgtttcgcgtcgcttattactttcagtttccttgtattttaaatatttgtatttatttcattaaatatttcattcgtatctgtt

SEQ ID NO: 107858 - DNA, 1265 bp, Homo sapiens
  Payload ID: 1174
  Gene Symbol: ANXA2R
  Gene Name: annexin A2 receptor
  Uniprot ID: Q3ZCQ2
  ENST ID: ENST00000616064
  CDS Start-End: 300-881
aatacctgcgttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttcattgctggttgtcagtttttaaattctctttttcccttatgtttctttcttgtttcgcgtcgcttattactttcagtttccttgtattttaaatatttgtatttatttcattaaatatttcattcgtatctgttttcactttgagaaatctattttacgattgtagaattcttagagtttttggcaaatttaaaatttgtttttttccattgtattttaaaatcttattcctactatttttctaattattgctttttaaatgtattgtttgtttacatttaatttt

SEQ ID NO: 107859 - DNA, 1657 bp, Homo sapiens
  Payload ID: 1175
  Gene Symbol: ANXA3
  Gene Name: annexin A3
  Uniprot ID: P12429
  ENST ID: ENST00000264908
  CDS Start-End: 380-1351
attgcagtacatttgagaaagtaaaggtgtagtggaaaccgagagcgaaatgagggcgtagggagaaaagggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagat

SEQ ID NO: 107860 - DNA, 1524 bp, Homo sapiens
  Payload ID: 1175
  Gene Symbol: ANXA3
  Gene Name: annexin A3
  ENST ID: ENST00000503570
  CDS Start-End: 399-1253
ggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctggacacggtctcactctgtcacctagactacagtgcagtgacacaatcacagctcactgcagccttgaccttctgcgctcaagtggtcctcccacctcagcctcccaagtagctgggaccacacctgcacaccaccacacctggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatc

SEQ ID NO: 107861 - DNA, 880 bp, Homo sapiens
  Payload ID: 1175
  Gene Symbol: ANXA3
  Gene Name: annexin A3
  ENST ID: ENST00000514171
  CDS Start-End: 418-880
ctcgaccctgggcagggctggcggctggcgcccgcgcccggccccaacccagctgcgtgggtggggagctggagggacctcagtcctgcatttcagagtcgaggagactgggcccacgggggggaaagtgccgtgccatgggtgggtcacccaggtcttggtggggcccaagctgatactcagctgtcctcgctccctgaaagcttcgcttattacagctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaag

SEQ ID NO: 107862 - DNA, 567 bp, Homo sapiens
  Payload ID: 1175
  Gene Symbol: ANXA3
  Gene Name: annexin A3
  ENST ID: ENST00000508214
  CDS Start-End: 165-567
cctcctcaaagagcagatgtgtctttataacagactgtaggcttggagccttgtaaaatgtacatggagtttcacaatcaagcacaaggaatccaactgaaggcagctaaactttgtgttgatttgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacag

SEQ ID NO: 107863 - DNA, 1335 bp, Homo sapiens
  Payload ID: 1175
  Gene Symbol: ANXA3
  Gene Name: annexin A3
  ENST ID: ENST00000512884
  CDS Start-End: 181-1035
ggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaag

SEQ ID NO: 107864 - DNA, 545 bp, Homo sapiens
  Payload ID: 1175
  Gene Symbol: ANXA3
  Gene Name: annexin A3
  ENST ID: ENST00000512373
  CDS Start-End: 233-545
actcgcacaccagtttcccccaccgcgctttggctagcagcgtaagggatccacttagccatctcggcctccccagtcctaaaggtctaggggacagaaaaaagctgggagtcggaaggttcctcgggtccccggcatggcagacggggctggctcagaggtctgctctgtggacttggaatcgcacccatcctattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagg

SEQ ID NO: 107865 - DNA, 307 bp, Homo sapiens
  Payload ID: 1175
  Gene Symbol: ANXA3
  Gene Name: annexin A3
  ENST ID: ENST00000512542
  CDS Start-End: 142-307
cggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctggggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaa

SEQ ID NO: 107866 - DNA, 2799 bp, Homo sapiens
  Payload ID: 1176
  Gene Symbol: ANXA4
  Gene Name: annexin A4
  Uniprot ID: P09525
  ENST ID: ENST00000394295
  CDS Start-End: 249-1214
gcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaacgtggaaaaataattttaatttaaaaatggtgtttttaggccgggggcgggggctcacgccagtaatcccaacactttgggaggccaaggcgggtggatcacctaaggtcaggagttcaagactagcctggccaacatggagaaactgcatctctactaaaaatataaaaattagccgggtgtggtggctggtgcctgtaatcccagccactcggaggctgagtcagggagaactgcttgaacccaggaggcaggaggcaaaggttgcagtgagccgagatcacgccagcctgggcgacagagcgagaatccatctaaaaaaaaaaaaaaaaaaagtgtctttaaagtgaggtatagtctttctctgatccacttttcaccttctgaggtttttcatcttggcccctgaaaggagctatttttgaaggacttgtgttactcagtttctacaggaattacaagataagaaaaaaaaaatcatatttagtcttatgcgtgcctactggctaatgttcacatatgccaaacactactcaataacataaaataatgtatgaacttattctctggaaatgagtgatgccctctgctctaagtagaccatttatattaaatatcataaatgtataaaggaca

SEQ ID NO: 107867 - DNA, 1414 bp, Homo sapiens
  Payload ID: 1176
  Gene Symbol: ANXA4
  Gene Name: annexin A4
  ENST ID: ENST00000409920
  CDS Start-End: 249-1148
gcgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaa

SEQ ID NO: 107868 - DNA, 1492 bp, Homo sapiens
  Payload ID: 1176
  Gene Symbol: ANXA4
  Gene Name: annexin A4
  ENST ID: ENST00000635311
  CDS Start-End: 91-519
gtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctgtgagtgactgcttctgatggggggcgggttttatcgaaatgtccactctatcccctttgccagcctttctcatcctttcagcccctgacatgtggatattccccaggtagtgttctcagacccctctgttcctttatcttatttctccttcagagactctggctaatcctgcctgcccattttttctactttaatttgatatttacaagtacctaacacctgccaggtccccctgtcactcagtgcattgagagttatgaagatgattcagaggcagttcctgggccttaagagtatatattgtcataagggaatacatcaggtacacagttgctagaaggcatgaaaagattacatgccaaaggagaggcgcataggaaaaagaagattcaaggagaaaatttggttgtagaaacaaagaaaagccttcatgacagagatgctggttcagagaggacttggaggattactagaatttcaagaggcagagacgtgggtgggtgtattgcagacaggaagaacagcaagaataaggcagggaacatggggttcagggaacaactgggtgaacagttgggctggtgattctggaaacagggtgggaggataaactggaattctatgttgggagcagtttacacttatttatttgggagcagtagatgacgtgatgatgacaacgatgatgggagtgatgtgactggagctgcactttcagaagagtaatgtaatagtgacgtgtaggatgaacagtggagaggaactggaggctggacgaccagggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctg

SEQ ID NO: 107869 - DNA, 376 bp, Homo sapiens
  Payload ID: 1176
  Gene Symbol: ANXA4
  Gene Name: annexin A4
  ENST ID: ENST00000472124
  CDS Start-End: 1-23
aaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcagaatatggacggagccttgaagatgacattcgctctgacacatcgttcatgttccagcgagtgctggtgtctctgtcagctatgacgtgatgatgacaacgatgatgggagtgatgtgactggagctgcactttcagaagagtaatgtaatagtgacgtgtaggatgaa

SEQ ID NO: 107870 - DNA, 521 bp, Homo sapiens
  Payload ID: 1176
  Gene Symbol: ANXA4
  Gene Name: annexin A4
  ENST ID: ENST00000468815
  CDS Start-End: 1-27
agccaaacctaccagcagcgtacgtgacatccgcagtggccctggctgaggtttcgctgtgattagagaatgagggtagcagcgggttgttgtttgctgattagacttttcacagaacgctgagcatgagggatcctcggtgccaagctctgcttcgagggagatccctgtttagccaaatggcggtctgttggctccttaagatttctcagaatatggacggagccttgaagatgacattcgctctgacacatcgttcatgttccagcgagtgctggtgtctctgtcagctgtgagtgactgcttctgatggggggcgggttttatcgaaatgtccactctatcccctttgccagcctttctcatcctttcagcccctgacatgtggatattccccaggtagtgttctcagacccctctgttcctttatcttatttctccttcagagactctggctaatcctgcctgcccattttttctactttaatttgatatttacaagtacctaacacctgccaggt

SEQ ID NO: 107871 - DNA, 1762 bp, Homo sapiens
  Payload ID: 1177
  Gene Symbol: ANXA5
  Gene Name: annexin A5
  Uniprot ID: P08758
  ENST ID: ENST00000296511
  CDS Start-End: 287-1249
aggcgcgctgaggccggggcaggggcgggcccggctggcgcggccggcctgcggttggggccctggcgggggtgggacgggccaagccgggcagggccggggtggggccgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttattt

SEQ ID NO: 107872 - DNA, 1606 bp, Homo sapiens
  Payload ID: 1177
  Gene Symbol: ANXA5
  Gene Name: annexin A5
  ENST ID: ENST00000506395
  CDS Start-End: 140-631
tgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggtattgcgtggagattaattacagtttgattaaaaagcctgaagttggactgggctgaatctagctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagatta

SEQ ID NO: 107873 - DNA, 1363 bp, Homo sapiens
  Payload ID: 1177
  Gene Symbol: ANXA5
  Gene Name: annexin A5
  ENST ID: ENST00000501272
  CDS Start-End: 140-922
tgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagatta

SEQ ID NO: 107874 - DNA, 1190 bp, Homo sapiens
  Payload ID: 1177
  Gene Symbol: ANXA5
  Gene Name: annexin A5
  ENST ID: ENST00000515017
  CDS Start-End: 136-798
ggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttggaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttc

SEQ ID NO: 107875 - DNA, 447 bp, Homo sapiens
  Payload ID: 1177
  Gene Symbol: ANXA5
  Gene Name: annexin A5
  ENST ID: ENST00000513728
  CDS Start-End: 149-256
aggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaag

SEQ ID NO: 107876 - DNA, 2593 bp, Homo sapiens
  Payload ID: 1178
  Gene Symbol: ANXA6
  Gene Name: annexin A6
  Uniprot ID: P08133
  ENST ID: ENST00000354546
  CDS Start-End: 229-2250
agaggggtggggtggaggagggaggcgggcgcgccggattggcctctgcgcgccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaa

SEQ ID NO: 107877 - DNA, 1430 bp, Homo sapiens
  Payload ID: 1178
  Gene Symbol: ANXA6
  Gene Name: annexin A6
  ENST ID: ENST00000377751
  CDS Start-End: 99-1091
gatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 107878 - DNA, 562 bp, Homo sapiens
  Payload ID: 1178
  Gene Symbol: ANXA6
  Gene Name: annexin A6
  ENST ID: ENST00000517486
  CDS Start-End: 94-562
agcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggtgctggcacagatgagaagactctgaccaggatcatggtatcccgcagtgagattgacctgctcaacatccggagggaattcattgagaaatatgacaagtctctccaccaagccattgagggtgacacctccggagacttcctgaagg

SEQ ID NO: 107879 - DNA, 1793 bp, Homo sapiens
  Payload ID: 1178
  Gene Symbol: ANXA6
  Gene Name: annexin A6
  ENST ID: ENST00000521512
  CDS Start-End: 107-1489
cgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaatgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggcta

SEQ ID NO: 107880 - DNA, 880 bp, Homo sapiens
  Payload ID: 1178
  Gene Symbol: ANXA6
  Gene Name: annexin A6
  ENST ID: ENST00000521749
  CDS Start-End: 431-880
agagaccagagagcatccagaggcctggccggggtcctgcagtgcagacgttgggaggcacggagacggggagagggggaggcggtccaggactcactctgctccacctctgactccttgaagggatcattttcatctcctatactcagccaggcttttttaccctctcctggatgctttggaaggtggtgcagggctgcaggccttggccaagcccccctcccttggggaaatggcactgtcctttgggcgggttgcagcaggtggtatgggaaagtcatccacaccgctccccagggtgtatgtggccagcactggattttgcagggaaagcagctcagcctggaccaggggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccag

SEQ ID NO: 107881 - DNA, 2451 bp, Homo sapiens
  Payload ID: 1178
  Gene Symbol: ANXA6
  Gene Name: annexin A6
  Uniprot ID: P08133
  ENST ID: ENST00000523714
  CDS Start-End: 187-2112
tccagaggcctggccggggtcctgcagtgcagacgttgggaggcacggagacggggagagggggaggcggtccaggactcactctgctccacctctgactccttgaagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 107882 - DNA, 553 bp, Homo sapiens
  Payload ID: 1178
  Gene Symbol: ANXA6
  Gene Name: annexin A6
  ENST ID: ENST00000517757
  CDS Start-End: 165-553
gctaacgggctccgatccagcgagcgctgcgtcctcgagtccctgcgcccgtgcgtccgtctgcgacccgaggcctccgctgcgcgggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgct

SEQ ID NO: 107883 - DNA, 728 bp, Homo sapiens
  Payload ID: 1178
  Gene Symbol: ANXA6
  Gene Name: annexin A6
  ENST ID: ENST00000519644
  CDS Start-End: 114-401
gggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatga

SEQ ID NO: 107884 - DNA, 795 bp, Homo sapiens
  Payload ID: 1178
  Gene Symbol: ANXA6
  Gene Name: annexin A6
  ENST ID: ENST00000517677
  CDS Start-End: 112-501
gctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgaca

SEQ ID NO: 107885 - DNA, 923 bp, Homo sapiens
  Payload ID: 1178
  Gene Symbol: ANXA6
  Gene Name: annexin A6
  ENST ID: ENST00000523164
  CDS Start-End: 593-923
ggacttgttatgatcgagggctgctaggcagagatgttggctgcttcctgggccctggcaagtcactttctctttctgagatgcctttaccccgtctagaaaatgagggacttggagtcatggattattaagggcccttgtgggattcagaaacactagatgtaaaatattcagccaatttgagcagtatggtctaggttgctctgggagggatcagaagccatcttaaagccagggtaaatggtgtgtttatgattagctcaggagcttcccagaaccctcagaggcggggctgtggaatcagcagggggactggccctcagaactgcagtctgaacatctagttctggaaggagcttgctttttacatatgaactgtgcactcacacaaggcacacagaaactgctctcagagctgagaatattttcccaaacagtaagaggcccctccttgaagccatctctccttggaaaggggagctcctccagatgggcctgggctgcagccagcagctgaaattgccagcaacaagcccagaggaaagtgcttcaaggctggagatgcagtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactg

SEQ ID NO: 107886 - DNA, 451 bp, Homo sapiens
  Payload ID: 1178
  Gene Symbol: ANXA6
  Gene Name: annexin A6
  ENST ID: ENST00000522664
  CDS Start-End: 1-274
tgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacata

SEQ ID NO: 107887 - DNA, 2174 bp, Homo sapiens
  Payload ID: 1179
  Gene Symbol: ANXA7
  Gene Name: annexin A7
  Uniprot ID: P20073
  ENST ID: ENST00000372919
  CDS Start-End: 58-1524
cccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagatcaatacagattctttttcttcctatcctgttttctctcctgtttctttggattatagcagtgaacctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 107888 - DNA, 2452 bp, Homo sapiens
  Payload ID: 1179
  Gene Symbol: ANXA7
  Gene Name: annexin A7
  Uniprot ID: P20073
  ENST ID: ENST00000372921
  CDS Start-End: 58-1458
cccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtacaatatggtgttttgatatcagcattccttgtgtaatgattccacaattaaggtcaggctaattacgtatctgtcaccttgacatagttaccattttttcatgtgtggtgaaaacacttaagatctactaccttagcaaattttaagtgttcagtacattattaactatagatactgtgctctacattaaacctctagcatttattcgttttataactgaaagtttataccctttgaccaacatctccccattttccccacctctcacctggacaaccaccactgtgtttaagttcagctattttagattccacgtataaatggtatacaata

SEQ ID NO: 107889 - DNA, 648 bp, Homo sapiens
  Payload ID: 1179
  Gene Symbol: ANXA7
  Gene Name: annexin A7
  ENST ID: ENST00000394847
  CDS Start-End: 215-648
tcagatttttttttcctttattttgaccctgacccttttgcccttggtctatctacttttctttttctttctttttttttttctttttccttgtcttgtcttgtcttttctttcaactggagtgcaatgatgcaaacacgactcactgccgccttgacctcctggcctcaagcaattctcccacctcagcttcctgaatagtttggactacagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtca

SEQ ID NO: 107890 - DNA, 1971 bp, Homo sapiens
  Payload ID: 1180
  Gene Symbol: ANXA8
  Gene Name: annexin A8
  ENST ID: ENST00000583448
  CDS Start-End: 151-216
gtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggactcaggaattctcccactccggaatgccttgctgctggggtgaccaggtcttcacttgtgaaacaggagtcggccacctcagccctgcgcctggcctggtggaacatgggtcaccgccccaacctggggcagccgccccatcccaacgcagttgctgccgctctccatgcctccctgtgcccagctaaccgggggacttgtcccctgggaaaacctgggtacccaggctgcctttggtttcagcccctactcctcttcccgggctgcctttgctccccggacggcccctttccccgggctgtgttcacatcggctgggaagggtcccttgcagacagatcttggacgaggtcgcgtcccccctcgtgaccagcaaactcctaaaagccgcccttgccccagagcccctgtagcctccaaccggcagtcaggaggcagcgccgtctcagcgccgcttagtggcgccaggcgtgcctggaaatccgctttcgcagcgccccctcgtagccgcctccgcccgcagaaaggcgttccctggacagagaagcgggcgcgcgggggcgggcgcgcggggccttgccggagaacctgactctccgcagcagcagtggaagccagagtgacgcgttgtgttgaacaccagttttctggagcgctgtgtgttctcatagctgagcagtctgtttctccaatcaggtttcaaagccacttcaactgcactggcccctgtgggtcactgctgcaccgccctggcccatgtgggtccctgaggagcgacctgccggggccacctggctggacgaaaaagacacaccttggacttaagccgtgagaaaaaaaaaacttcatcagtaagaaacaagtcaatagacaagtaaaagactaggagaaaatatgcataaaacataaaaaagtgacttgattcctgattctggagtatttaagaattcctataactcaacaaaaagttcagttttttaaaatgagcaaaaggcttgggtaaactattcacaaaggaacatagacaaatgccagtacacacatgagaagcgcatacacatccacaaacttcaaacaagcccacctcatgtatttctagtgagtaaggaaaagaacgcaaacacttttgaaaattgtttggttgtttcttgtaaatttaaacaaataccctattatattatccagcgagtccatccttaggtttttatccaaggataaagaggtgaaaactcatatctaacaaatagacttctgaaaagatgaaaatagaagctttattcataaaagacaaaaactagaaataacccaaatattcattcacaggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaaaatgaatctgtgatttaaaaatcagactagtattaggttggtgcaaaagtaattgcggtttttgccttttttttttttttttttaaatagttgctttggggtttatggatggagtggcatggtagaggttagctgaagggggcatgaaataactttttgggggtgctagagtgttgtaaatcttacagtgggggagggacaggagtgcaggcatttgacaaaacacattgaattgtgaaatttaagatttttgaatttctttgtatgtaaattacctgccaataaaaacatgacgaatagagca

SEQ ID NO: 107891 - DNA, 1960 bp, Homo sapiens
  Payload ID: 1180
  Gene Symbol: ANXA8
  Gene Name: annexin A8
  Uniprot ID: P13928
  ENST ID: ENST00000585281
  CDS Start-End: 123-1106
cccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaa

SEQ ID NO: 107892 - DNA, 1874 bp, Homo sapiens
  Payload ID: 1180
  Gene Symbol: ANXA8
  Gene Name: annexin A8
  Uniprot ID: P13928
  ENST ID: ENST00000583911
  CDS Start-End: 226-1023
ctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 107893 - DNA, 1171 bp, Homo sapiens
  Payload ID: 1180
  Gene Symbol: ANXA8
  Gene Name: annexin A8
  Uniprot ID: P13928
  ENST ID: ENST00000577813
  CDS Start-End: 84-509
aggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggtcatttcccagtgtgagcacaatgccaaccttagtgtttctccagccagacagatgcctcagcatgaagggcttggggacttgtggatcattccttcctccctgca

SEQ ID NO: 107894 - DNA, 1860 bp, Homo sapiens
  Payload ID: 1180
  Gene Symbol: ANXA8
  Gene Name: annexin A8
  ENST ID: ENST00000583874
  CDS Start-End: 176-1006
gggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaa

SEQ ID NO: 107895 - DNA, 2174 bp, Homo sapiens
  Payload ID: 1180
  Gene Symbol: ANXA8
  Gene Name: annexin A8
  ENST ID: ENST00000611843
  CDS Start-End: 226-1323
ctgggtggggcctgggagccacaggagatgcccaaagccaggcagagcccgggggcgaggggacggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 107896 - DNA, 2174 bp, Homo sapiens
  Payload ID: 1181
  Gene Symbol: ANXA8L1
  Gene Name: annexin A8-like 1
  ENST ID: ENST00000584982
  CDS Start-End: 226-1323
ctgggtggggcctgggagccacaggagacgcccaaagccaggcagagcccgggggcgagggggcggcaggcaggtgtagcgctgccctgggagggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 107897 - DNA, 1874 bp, Homo sapiens
  Payload ID: 1181
  Gene Symbol: ANXA8L1
  Gene Name: annexin A8-like 1
  ENST ID: ENST00000613703
  CDS Start-End: 226-1023
ctgggtggggcctgggagccacaggagacgcccaaagccaggcagagcccgggggcgagggggcggcaggcaggtgtagcgctgccctgggagggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctgggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 107898 - DNA, 1109 bp, Homo sapiens
  Payload ID: 1181
  Gene Symbol: ANXA8L1
  Gene Name: annexin A8-like 1
  Uniprot ID: Q5VT79
  ENST ID: ENST00000619162
  CDS Start-End: 126-1109
acccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctga

SEQ ID NO: 107899 - DNA, 1861 bp, Homo sapiens
  Payload ID: 1181
  Gene Symbol: ANXA8L1
  Gene Name: annexin A8-like 1
  Uniprot ID: Q5VT79
  ENST ID: ENST00000622769
  CDS Start-End: 177-1007
cgggggcgagggggcggcaggcaggtgtagcgctgccctgggagggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaa

SEQ ID NO: 107900 - DNA, 1398 bp, Homo sapiens
  Payload ID: 1181
  Gene Symbol: ANXA8L1
  Gene Name: annexin A8-like 1
  ENST ID: ENST00000611655
  CDS Start-End: 97-909
actcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgtttta

SEQ ID NO: 107901 - DNA, 1826 bp, Homo sapiens
  Payload ID: 1182
  Gene Symbol: ANXA9
  Gene Name: annexin A9
  Uniprot ID: O76027
  ENST ID: ENST00000368947
  CDS Start-End: 477-1514
ggtcccacctggacccacagggaaggcagtgcataaaagcctcctgtgtttgaggctgagccgctgagaggctgagtggagttcactcacatggattgaggcccagttcctgggagaagagatgctgggcaggaaggtgtctgcatgtgggactctgtacagcccggtcctctcccacgtctgggaggggccagagtcagacaactgctgggttcgtccctaagagaggtcatctgactggctgttcagcctaggctgcacacacccccactttcctctaccaggccacaccggaggcagtgctcacacaggcaagctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatgacatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaa

SEQ ID NO: 107902 - DNA, 2118 bp, Homo sapiens
  Payload ID: 1183
  Gene Symbol: ANO1
  Gene Name: anoctamin 1, calcium activated chloride channel
  Uniprot ID: Q5XXA6
  ENST ID: ENST00000316296
  CDS Start-End: 106-2034
acgcacactgagtccaggtcctcctgaaggtcaccagcacagcggggccctgtgttactgtagagagaagtcagttgcttagtttcagcctcctgccggcaccagatgctgaccaggccctcccaggtgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagaggtaaccgaaattttattcatctctggcagccccttctgtcttgcttacgatttgtctacaccatgcacttgggagaagcagctgcagcacatttgttcagcaaagagcagcaggtttctttccttcttgctggaaacttttctgttcccctgatgtggtggggtgggctttaatcttatctggtgtgttcatatagaatcacctagaaggataaagtcgctgtagagttaatgaaag

SEQ ID NO: 107903 - DNA, 4790 bp, Homo sapiens
  Payload ID: 1183
  Gene Symbol: ANO1
  Gene Name: anoctamin 1, calcium activated chloride channel
  Uniprot ID: Q5XXA6
  ENST ID: ENST00000355303
  CDS Start-End: 306-3266
aaaggcgggccggctggcgtccaagttcctgaccaggcgcgggccggcccgcgggaccagcagccgggtggcggcgcgatcggccccgagaggctcaggcgccccccgcatcgagcgcgcgggccgggcgggccagggcggcgggcggagcgggaggcggccacgtccccggcgggcctgggcgcggggaggcccggccccctgcgagcgcgccgcgaacgctgcggtctccgcccgcagaggccgccggggccgtggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagaagcgccggcatattccagaggagtcaacaaacaaatggaagcagagggttaagacagccatggcgggggtgaaattgactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacga

SEQ ID NO: 107904 - DNA, 3552 bp, Homo sapiens
  Payload ID: 1183
  Gene Symbol: ANO1
  Gene Name: anoctamin 1, calcium activated chloride channel
  ENST ID: ENST00000531349
  CDS Start-End: 217-2304
tgggtcaaccctccctgaataaatgccattgtctttccttggaagatagcaccaaggaggtcttcatgcgtaacgtgtgaccaggtcctctccagccacagcagactgtttctgctcgtggaaggtgccttaagtaactgctcaccccccttcttgtctctgcaataggtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccgtagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctca

SEQ ID NO: 107905 - DNA, 806 bp, Homo sapiens
  Payload ID: 1183
  Gene Symbol: ANO1
  Gene Name: anoctamin 1, calcium activated chloride channel
  ENST ID: ENST00000530480
  CDS Start-End: 1-806
tccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatggggcaaggcgagggaagaaagaaggactccgcccttctaagtaaaaggcggaaatgtgggaagtatggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttc

SEQ ID NO: 107906 - DNA, 3289 bp, Homo sapiens
  Payload ID: 1183
  Gene Symbol: ANO1
  Gene Name: anoctamin 1, calcium activated chloride channel
  Uniprot ID: Q5XXA6
  ENST ID: ENST00000530676
  CDS Start-End: 490-3012
tgagtccaggtcctcctgaaggtcaccagcacagcggggccctgtgttactgtagagagaagtcagttgcttagtttcagcctcctgccggcaccagatgctgaccaggccctcccaggtggtgagcaatgctgtttccaggagaggcatcctagggccagagaggccaaggtgccagggacatggccccaactgtcccctaaccaggggtagaggagtctagacccttgacatcaacacctatgaaagctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctca

SEQ ID NO: 107907 - DNA, 577 bp, Homo sapiens
  Payload ID: 1183
  Gene Symbol: ANO1
  Gene Name: anoctamin 1, calcium activated chloride channel
  ENST ID: ENST00000531300
  CDS Start-End: 124-577
tctaaatcaagacaggagcaacaggaaagaacctactgcggctgagaggtgtgagcggagaggggagggacaaagcccccatcccgggcccttttcacactggctgtcaaggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaa

SEQ ID NO: 107908 - DNA, 789 bp, Homo sapiens
  Payload ID: 1183
  Gene Symbol: ANO1
  Gene Name: anoctamin 1, calcium activated chloride channel
  ENST ID: ENST00000531604
  CDS Start-End: 35-789
gccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacga

SEQ ID NO: 107909 - DNA, 3212 bp, Homo sapiens
  Payload ID: 1184
  Gene Symbol: ANO10
  Gene Name: anoctamin 10
  Uniprot ID: Q9NW15
  ENST ID: ENST00000292246
  CDS Start-End: 172-2154
gaccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtaccgcaatgggcttcccttttctgaagcacttggtgaggtcactgaaggtggagcggtgagatcaggagcccagggtgaggggcttggctggaggccaggcaccaaagcttgtagctgaaggctgggccatttttgagaactgctgctggtggtgcccacctacagggacactagggctgctttcacatgcagggtgtacccatggtgccaagccaagggccagcagccactcctggtgccctggcctgggcttgggcttgcagagaaaagggccctccttgcccagtggtgctgcccacctccctagctgtgtccatggactgccctgcattcacaggcacaagaatgccatgtaggccagtgctgcccacgtatacagcccttcccaccagcgctggccgtcctgctgtagccaagacactacagacccgtgggcacctccactcggacagcagcagatgccctggccc

SEQ ID NO: 107910 - DNA, 2039 bp, Homo sapiens
  Payload ID: 1184
  Gene Symbol: ANO10
  Gene Name: anoctamin 10
  Uniprot ID: Q9NW15
  ENST ID: ENST00000350459
  CDS Start-End: 69-1481
ccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaa

SEQ ID NO: 107911 - DNA, 2419 bp, Homo sapiens
  Payload ID: 1184
  Gene Symbol: ANO10
  Gene Name: anoctamin 10
  Uniprot ID: Q9NW15
  ENST ID: ENST00000396091
  CDS Start-End: 88-1872
gcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggagataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagct

SEQ ID NO: 107912 - DNA, 2019 bp, Homo sapiens
  Payload ID: 1184
  Gene Symbol: ANO10
  Gene Name: anoctamin 10
  Uniprot ID: Q9NW15
  ENST ID: ENST00000451430
  CDS Start-End: 107-1756
ggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggagtgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgcca

SEQ ID NO: 107913 - DNA, 2450 bp, Homo sapiens
  Payload ID: 1184
  Gene Symbol: ANO10
  Gene Name: anoctamin 10
  Uniprot ID: Q9NW15
  ENST ID: ENST00000414522
  CDS Start-End: 115-1998
actggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggaggctgcaagctgcaagctggtctctcttccacggtattcatggagcaccaactcagtgccaggcactgtcataggtcctggggtctagtcatggccctgctctctggagaccacataccagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcact

SEQ ID NO: 107914 - DNA, 560 bp, Homo sapiens
  Payload ID: 1184
  Gene Symbol: ANO10
  Gene Name: anoctamin 10
  ENST ID: ENST00000439141
  CDS Start-End: 159-560
ttcctacggctacgggaaggatcgtccagtggctgaggctggacagagcacagtagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaat

SEQ ID NO: 107915 - DNA, 511 bp, Homo sapiens
  Payload ID: 1184
  Gene Symbol: ANO10
  Gene Name: anoctamin 10
  ENST ID: ENST00000413397
  CDS Start-End: 90-511
atcccctccaaggaagcgccgccccttcctacggctacgggaaggatcgtccagtggctgaggctggacagagcacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaa

SEQ ID NO: 107916 - DNA, 575 bp, Homo sapiens
  Payload ID: 1184
  Gene Symbol: ANO10
  Gene Name: anoctamin 10
  ENST ID: ENST00000444344
  CDS Start-End: 137-575
agggcacctcggaccccccagctgtccgcagcagagcccggccccttgcagccacagagccccggccgctgcaggctccaggagctccgcctggtcgccgccctgcgttcccgggccgcctcccgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttacc

SEQ ID NO: 107917 - DNA, 545 bp, Homo sapiens
  Payload ID: 1184
  Gene Symbol: ANO10
  Gene Name: anoctamin 10
  ENST ID: ENST00000456438
  CDS Start-End: 123-545
gctctcggacccgcctccgaagacgtggagcgctgcggcggctggcagctgccctaggtacaaggagggaggctcccacaattgctctcaccattaactgcctgcctgtagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaa

SEQ ID NO: 107918 - DNA, 497 bp, Homo sapiens
  Payload ID: 1184
  Gene Symbol: ANO10
  Gene Name: anoctamin 10
  ENST ID: ENST00000436073
  CDS Start-End: 382-497
ggctttgcgtccgccatccccagccagcatgcactagttctcccgcccgacgctcccgggtgtaagcgcggggcgggacagtcagcccagagggactggcgagactcacccgaatgagttaggtgttttagctaatttgaataatgactgtattcatgcatcaccccgtcggtgttggctgtcaggtggcaccttggggacggaggtgcgtccggtcctggaagagcctagctagtgtccgatagatggtgcagtggcaaatgaaatggcgtaatcgagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaat

SEQ ID NO: 107919 - DNA, 746 bp, Homo sapiens
  Payload ID: 1184
  Gene Symbol: ANO10
  Gene Name: anoctamin 10
  ENST ID: ENST00000427171
  CDS Start-End: 170-746
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgtttcaacttcctcaattgctttgcctcactcttctatattgcctttgtcttgaaagatatgaagcttttgcgccagagcttggccactctcctaattacctcccag

SEQ ID NO: 107920 - DNA, 641 bp, Homo sapiens
  Payload ID: 1184
  Gene Symbol: ANO10
  Gene Name: anoctamin 10
  ENST ID: ENST00000428831
  CDS Start-End: 305-641
gcgtccgccatccccagccagcatgcactagttctcccgcccgacgctcccgggtgtaagcgcggggcgggacagtcagcccagagggactggcgagactcacccgaatgagttaggtgttttagctaatttgaataatgactgtattcatgcatcaccccgtcggtgttggctgtcaggtggcaccttggggacggagtagagatggggtttcaccatgttggccaggatggtctcaatcttctgacctcatgatccgcccacctcggcctcccaaggtgctgggattacagatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatg

SEQ ID NO: 107921 - DNA, 583 bp, Homo sapiens
  Payload ID: 1184
  Gene Symbol: ANO10
  Gene Name: anoctamin 10
  ENST ID: ENST00000448045
  CDS Start-End: 1-566
cctgtgtttacccattagcagctgcctttgctgtgttaaataacttcactgaagtaaattcagatgccttaaaaatgtgcagggtcttcaaacgtccattctcagaaccttcagccaatattggtgtgtggcagatcatattttgtttggacacaggtgtaaagagagggctgaattgcaaggtcatgaggaatcttttgggggaaatggaaatgtcctgtgtcttgtttgtggtggtggtggtttcacagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccag

SEQ ID NO: 107922 - DNA, 592 bp, Homo sapiens
  Payload ID: 1184
  Gene Symbol: ANO10
  Gene Name: anoctamin 10
  ENST ID: ENST00000428472
  CDS Start-End: 107-592
ggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggagtgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtggggg

SEQ ID NO: 107923 - DNA, 3720 bp, Homo sapiens
  Payload ID: 1185
  Gene Symbol: ANO2
  Gene Name: anoctamin 2, calcium activated chloride channel
  Uniprot ID: Q9NQ90
  ENST ID: ENST00000327087
  CDS Start-End: 73-3072
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagaaatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatg

SEQ ID NO: 107924 - DNA, 3717 bp, Homo sapiens
  Payload ID: 1185
  Gene Symbol: ANO2
  Gene Name: anoctamin 2, calcium activated chloride channel
  Uniprot ID: Q9NQ90
  ENST ID: ENST00000356134
  CDS Start-End: 73-3072
ccaggctccttctctataaagtgggatctatcatgaccagcctaccttatcaatataggagagaaaatcttcatgcctgaagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagaacgtgcccaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaag

SEQ ID NO: 107925 - DNA, 3702 bp, Homo sapiens
  Payload ID: 1185
  Gene Symbol: ANO2
  Gene Name: anoctamin 2, calcium activated chloride channel
  ENST ID: ENST00000546188
  CDS Start-End: 43-3054
agaagcgcgcggccgcgggccggcggggtctgcgtccacatcatggcgactcccgggccgcgcgatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtcatcaacaactatctggatgccaatgagcctgtgtccttggaggcccgtcttagccgcatgcacttccatgacagtcagaggaaggtcgactatgtacttgcctaccactaccggaaacgcggggtgcacctggcccaaggcttccctggccactcgctggctatcgtctccaatggggagacaggcaaggagcctcatgctgggggcccaggtgacattgagctgggaccgctcgatgccctggaggaggagaggaaggagcagcgggaggaatttgagcacaatctgatggaggctggactggagcttgagaaggacttggagaataaaagccagggatccatctttgtccggatacacgccccgtggcaggtgctggccagagaggcagaattcttgaagatcaaagttcctaccaagaaagagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtacaacatccaggaaaaggacaccttctttgataatgccacccgcagccgcattgtgcacgagatcctgaagcgcacagcctgctcccgagccaacaacacgatgggtattaactctctgatcgcaaacaatatctatgaggctgcctaccctcttcatgacggtgaatacgatagtccagaggacgatatgaatgacaggaagctgctatatcaagaatgggcgcgctatggagtgttctataagttccaacctattgacctcatcagaaagtattttggagaaaaaattggactgtattttgcctggctgggattatatacatcattcctcatcccatcttctgtaattggagtgattgtgtttctttatggatgtgcaacaattgaagaagatattcccagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtgggctaccatgttcctggaaaactggaagaggctacagatgcgactgggctacttttgggacctgactggcatagaagaggaagaagtgagttctcaggaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggtttgtgggcaggcctggaagctacgtctatgtattcgatggttaccgcatggaagagtgtgctccagggggctgtctcatggagctctgcattcagctcagcatcatcatgttggggaagcagttgatccagaacaacatctttgagattggagtcccgaagctaaagaaactatttcgaaagctgaaagatgagaccgaagctggagaaactgactctgcccattcgaaacatccagagcagtgggacctagactacagcttggaaccatacacaggactgactccggagtacatggaaatgatcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggaatctggtttgacattctctctggaattggcaagttctctgttatcagcaacgcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtttaaggattaccgagagccgccatgggccccgaacccttatgagttttcgaaacagtactggtttattctgtccgcccgtctggcttttgtcataatcttccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatg

SEQ ID NO: 107926 - DNA, 640 bp, Homo sapiens
  Payload ID: 1185
  Gene Symbol: ANO2
  Gene Name: anoctamin 2, calcium activated chloride channel
  ENST ID: ENST00000545860
  CDS Start-End: 31-640
acagagattattctatcagctacatgcaggatgggttggaaggctgaaagtctggagtcagctaccatgttcctggaaaactggaagaggctacagatgcgactgggctacttttgggacctgactggcatagaagaggaagaagaacattccaggcctgagtatgaaaccaaagttcgagagaaaatgctaaaggagagcaaccagtctgctgtccagaaattggaaacaaacacgacggagtgtggcgatgaggatgatgaagataaactgacctggaaggatcgtttcccaggttacctgatgaactttgcctccatcttattcatgattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattgaggttccgaaaacagaacagacttttgaagagcgcctgatcctcaaagctttcttgctcaagtttgtcaatgcctactcccccatcttctatgtggcctttttcaaagggaggt

SEQ ID NO: 107927 - DNA, 1087 bp, Homo sapiens
  Payload ID: 1185
  Gene Symbol: ANO2
  Gene Name: anoctamin 2, calcium activated chloride channel
  ENST ID: ENST00000612575
  CDS Start-End: 186-446
ggaagagtgtgtgacttggtgaagcagctcccaagcacccaagatgcccaggagcctctggaagcagcagttggtccccagtgtcttcccctgaacccctaggaacatgtagggttcaagggctcagtcccagtctcagaggggaaaaggcatgtgagcgtgcaactggcagccagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttat

SEQ ID NO: 107928 - DNA, 6642 bp, Homo sapiens
  Payload ID: 1186
  Gene Symbol: ANO3
  Gene Name: anoctamin 3
  Uniprot ID: Q9BYT9
  ENST ID: ENST00000256737
  CDS Start-End: 853-3798
ctttcaaataaggtgttgatttatgtggtcttgagaaatctttgttgctctgatcttaagtttctttttataatattagaatcatagtttacctacattacagggcttttatgaagattaaatcgagcatcgtgggtagtgttttttcagcccctgtgactaagtaggttataaatggtcctcagtcatcatcatcataaatgattcaaggcctgaatggcagaagaagaagaggaaaactcaagtgaaaagtgctagacatagaacacagcttacctaataaaacatgctactggctaactaagctggggtggctttctgccccctctacttaaatttaagaaagaaaaacagaaacgtctctgcatctgccactgcataccctctcagagcacagaccaactttgcccttccttaaaagtcccagggtttacctaccaacttttaggaaataaataaccagcctcaaagcttggcaaagagggcatcagtatcagctctagaggtttgctccgatttatatctcctcctccagtaaagtcttctgctcccactcccagccaaccccgctcaacgcccacccctcactgtggcactggacgcgcgggggatgcggggttgttcccagagtagccgctaaggggagccggacgctagaccgccctcccgcgttcccatgacaacgacaccggcgggcgcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaagagaattgattacatcttggtttatagaaagacaaatatacaatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaaaactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctatactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatgggccacagtcttcctggagttttggaaaaggagaaggagtatactgacctatacttgggaccttatcgaatgggaagaagaggaggaaacacttcgtccccagtttgaagccaagtattacaagatggagattgtaaatcccatcacgggaaaacctgaaccacatcagccttcctcagacaaagtcactcgtcttcttgtttctgtctcaggaatattcttcatgatatccttggtgatcactgcagtgtttggagttgtggtgtaccgcctggttgtcatggaacagtttgcatcattcaagtggaatttcatcaaacaatactggcagtttgcaacatctgctgctgctgtctgtatcaatttcataatcattatgttgctgaatcttgcttatgaaaaaattgcttacctcctcaccaatttagaatatcctcgaacagaatcagagtgggaaaacagcttcgccctgaagatgttcctcttccagtttgtcaatttaaacagttccatcttctatatcgctttctttttgggaagattcgtaggccacccaggaaaatacaataaactttttgaccggtggagactggaggaatgtcatcctagtggctgtttgatagacctctgcctccagatgggtgtcatcatgtttttgaagcaaatatggaacaacttcatggaactaggatacccgttgatccagaactggtggtcacgacataaaatcaagcggggaatacatgatgcttccatacctcagtgggaaaatgattggaatctgcagcccatgaaccttcatggactgatggatgagtacttagaaatggttttgcaatttggttttaccaccatctttgttgcggcttttcctctagcccctcttttggctttgttaaacaatatcattgaaatcaggctggatgcatacaaatttgtcactcaatggcggaggcctttgccagcccgagcaactgacataggtatctggcttggaattctcgaaggaatcggtatattggctgtgatcaccaatgcatttgtaattgctattacttctgattacatcccacgttttgtttatgaatacaaatatggcccctgtgcaaatcatgtagaaccaagtgaaaattgcttgaagggatatgtcaacaatagcctatccttctttgacctgagtgagcttggtatgggaaaatctggttattgcaggtacagagactacagaggcccgccctggagttccaaaccctatgagtttactttacaatactggcatatccttgctgctagattggccttcattattgtgtttgagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgtaattctcagaaccagtctcagggagatatatgcttggagaactctgccttccatcaactgcagtgtaatgggaaagagggtggtgaggttttgaaagacagatttccatgtaaatgtgcacaagccaggcatggcttaaaatatcatgcagtcttcactcacatactaatttgactttggaaagtatggttgagttcagatacttataagaaatgacttaaacaaatccttgccttggctgccagaactctacatcccttcagtttacaggttggtaggaattgcccatgtctcttgctgagattatggatctgtgccacaggggatttatgctgctttacattgactatgcagttgaagagttgcacatcacctttagtagtcaaaccaaaaatctaagattccaaaaagaacagcattcattgaaataatattccattgcattggctacttcaagtctcttttacccctggcagagccagttgcagtgcaattttttgtactaaatgccaataaagccacatacttataaactatgaatggctattcttatatagtttagaacacaactaatccatactttattgtggaaggctgttttatagtttatttaattttttctctatgatttattacaactctcacggaatattaacttgaaatgctgtaaatacgttggttttccttgtccctttgcaccttgacagtacgtagtatacattgtggtttatgcagctctgacaccagtttttgctattgtaatatgtttattcgggaaaactgaggccagatgctctgcaacacttacgctttttcaacaatgtgcactcttactcatgaactaatgaaaataatgcatgaatataaatctatattatttgctaaaaaaagaaaaaacatttgtgttttagtttcttttttcatgactgaagggagttttatgttattatttcttccatagttttgttttggtttatttttaacaacgctctagaaacaaagtcaaattaatcacaaaagacataattttgctttgttgtggaatttctatttcaacgtcaactctgtatctatgagtatgtctgttccacagacagatgaggcaggagtgatggggcactcaagaaagttcagaggaggcataagctatggaggttggaaaggaagaaagagaagagctgaagtaaatgtatggtagaaattaagacgtttctttgcaaaacaaggaaatcacacatatgcacacatacatatttatggttactatgattgttattatttgtccaatcaagcaaagcaccattatttctaacatataaaagaccagatcaaacacaatggaaataaagctactacatatatatgccagtatttctctagtaagattatgtttctcttactagaaaactattttctaaatattaacactgaaaatgttttgttagcttttccttctttctctccagaagaaacatggatagatgatagctgtttcattgtttgtttttgtcaagcatattcactttcctccttgtcctctgattctgagcaaagggcctcagactctgaacttccctcaagtgccgttgttatgtgaaactcttccattcagattccagagaggttctcatgctcccccccctccttatttgtagcaatcgtagcaactaattccactaagtacaagggagttttttacactcctccatttttatagcatctgcatttctttttctttgttaggtacatgtatacacctgcctgagtataaatactctctctacctaataataacatcaaccaacatcttttccaaattagggccacagaacagcaacatttgtctgacagtagtataaagaataatgatagctctatccttaagaagtatttcctttcctttttatatagtcccgttagggtttaaaaccatattgatcaactagaaagaaaaatatgaaaagagaaaaatattttaatttaaaaattgtaatacattgatttataaaatgccttctctgatacttttgaaacagatgtgaaaaacagaaaaagaaaaaattgtctgaaatgtttattttgcaaaacagtgcaatagaatctagttatgccttcatcactgttgacagtaaatactgacagccccttgcagtgtgttagttttagatcactctgttttagttgagagaaatgttttatatcatggtttttatatgaatacaaattatttctcaaagatttatagcacacactattctcaggaattctgtattacatgaatgctgcttatatattttcatattctaacttgtcttttcaagcaaataactaatatatatgtgcatgcagtctgccttgacaagttgttccaagctgaagagctttcactgtacaatgtgtggaaaatcaccatagatcatggctgaaatagtttgtaattgtctgagtctgtgcacgtacttttagataaaatgctgctgagtgactgcatgatgagatacaacttctgaatgctgcacattcttccaaaatgatccttagcacaatctattgtatgatggaatgaatagaaaactttttcactcaataaattattatttgatatggt

SEQ ID NO: 107929 - DNA, 3117 bp, Homo sapiens
  Payload ID: 1186
  Gene Symbol: ANO3
  Gene Name: anoctamin 3
  Uniprot ID: Q9BYT9
  ENST ID: ENST00000531568
  CDS Start-End: 234-2741
aaatgattattcaaactctggcatttagagagtaggctaaaaaccctccagtcaaatgctttgtgtagcactcagtatgtaacattctagttaatggaaaaagcaggcggtgaaagggagaactttcagttgtcacactgaagagtgctttaaagaagattgtcatttgagactgttgtcagcaatgaaggattccaaatgcagctgaactcagaattctgactgtgaatgacatgaattacatagcatccagtggacctctgttcaaagatggcaaaaagagaattgattacatcttggtttatagaaagacaaatatacaatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaaaactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctatactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatgggccacagtcttcctggagttttggaaaaggagaaggagtatactgacctatacttgggaccttatcgaatgggaagaagaggaggaaacacttcgtccccagtttgaagccaagtattacaagatggagattgtaaatcccatcacgggaaaacctgaaccacatcagccttcctcagacaaagtcactcgtcttcttgtttctgtctcaggaatattcttcatgatatccttggtgatcactgcagtgtttggagttgtggtgtaccgcctggttgtcatggaacagtttgcatcattcaagtggaatttcatcaaacaatactggcagtttgcaacatctgctgctgctgtctgtatcaatttcataatcattatgttgctgaatcttgcttatgaaaaaattgcttacctcctcaccaatttagaatatcctcgaacagaatcagagtgggaaaacagcttcgccctgaagatgttcctcttccagtttgtcaatttaaacagttccatcttctatatcgctttctttttgggaagattcgtaggccacccaggaaaatacaataaactttttgaccggtggagactggaggaatgtcatcctagtggctgtttgatagacctctgcctccagatgggtgtcatcatgtttttgaagcaaatatggaacaacttcatggaactaggatacccgttgatccagaactggtggtcacgacataaaatcaagcggggaatacatgatgcttccatacctcagtgggaaaatgattggaatctgcagcccatgaaccttcatggactgatggatgagtacttagaaatggttttgcaatttggttttaccaccatctttgttgcggcttttcctctagcccctcttttggctttgttaaacaatatcattgaaatcaggctggatgcatacaaatttgtcactcaatggcggaggcctttgccagcccgagcaactgacataggtatctggcttggaattctcgaaggaatcggtatattggctgtgatcaccaatgcatttgtaattgctattacttctgattacatcccacgttttgtttatgaatacaaatatggcccctgtgcaaatcatgtagaaccaagtgaaaattgcttgaagggatatgtcaacaatagcctatccttctttgacctgagtgagcttggtatgggaaaatctggttattgcaggtacagagactacagaggcccgccctggagttccaaaccctatgagtttactttacaatactggcatatccttgctgctagattggccttcattattgtgtttgagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgtaattctcagaaccagtctcagggagatatatgcttggagaactctgccttccatcaactgcagtgtaatgggaaagagggtggtgaggttttgaaagacagatttccatgtaaatgtgcacaagccaggcatggcttaaa

SEQ ID NO: 107930 - DNA, 3257 bp, Homo sapiens
  Payload ID: 1186
  Gene Symbol: ANO3
  Gene Name: anoctamin 3
  ENST ID: ENST00000525139
  CDS Start-End: 124-3021
gagtttctgagcaatttttatttttctcttttgttctctctcacaggtctgcaaaagttgtgcttttctcatcgtgagcttgagaagagtgtgtgggctgccaaaggcaaatataatgaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaagagaattgattacatcttggtttatagaaagacaaatatacaatatgataaaagaaacacatttgaaaagaacctcagagcagaaggcttgatgttggagaaggagccagctattgcaagccccgatatcatgtttattaaaattcacattccatgggacacgctgtgcaagtatgcagagaggctgaatatcaggatgcccttcaggaaaaaatgctattacactgacgggaggagcaaatcaatgggcaggatgcaaacttattttagaagaatcaaaaactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagccagcccattaaaacccatggacctcagaataacagacatctattatatgagcgctgggcacgctggggaatgtggtataagcatcagcctctggatttaatcaggctatactttggtgagaagattggactatactttgcttggctgggatggtatactggaatgttgattcctgcagcaattgttggtttgtgcgttttcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatgggccacagtcttcctggagttttggaaaaggagaaggagtatactgacctatacttgggaccttatcgaatgggaagaagaggaggaaacacttcgtccccagtttgaagccaagtattacaagatggagattgtaaatcccatcacgggaaaacctgaaccacatcagccttcctcagacaaagtcactcgtcttcttgtttctgtctcaggaatattcttcatgatatccttggtgatcactgcagtgtttggagttgtggtgtaccgcctggttgtcatggaacagtttgcatcattcaagtggaatttcatcaaacaatactggcagtttgcaacatctgctgctgctgtctgtatcaatttcataatcattatgttgctgaatcttgcttatgaaaaaattgcttacctcctcaccaatttagaatatcctcgaacagaatcagagtgggaaaacagcttcgccctgaagatgttcctcttccagtttgtcaatttaaacagttccatcttctatatcgctttctttttgggaagattcgtaggccacccaggaaaatacaataaactttttgaccggtggagactggaggaatgtcatcctagtggctgtttgatagacctctgcctccagatgggtgtcatcatgtttttgaagcaaatatggaacaacttcatggaactaggatacccgttgatccagaactggtggtcacgacataaaatcaagcggggaatacatgatgcttccatacctcagtgggaaaatgattggaatctgcagcccatgaaccttcatggactgatggatgagtacttagaaatggttttgcaatttggttttaccaccatctttgttgcggcttttcctctagcccctcttttggctttgttaaacaatatcattgaaatcaggctggatgcatacaaatttgtcactcaatggcggaggcctttgccagcccgagcaactgacataggtatctggcttggaattctcgaaggaatcggtatattggctgtgatcaccaatgcatttgtaattgctattacttctgattacatcccacgttttgtttatgaatacaaatatggcccctgtgcaaatcatgtagaaccaagtgaaaattgcttgaagggatatgtcaacaatagcctatccttctttgacctgagtgagcttggtatgggaaaatctggttattgcaggtacagagactacagaggcccgccctggagttccaaaccctatgagtttactttacaatactggcatatccttgctgctagattggccttcattattgtgtttgagcaccttgtttttgggattaagtcattcatcgcatacctgattccagacgtaccaaagggtctacatgaccgaatacgacgagagaagtacttagttcaagaaatgatgtatgaggctgaactggaacatttgcaacaacaacggagaaaaagtggtcagcctgttcaccatgaatggccttagttgacacctgttacccattaggggtgataacattaatgggaagaaatgatggcaactttgaatgctaggtgaaatctaggaggaaggcatacttggcaaaccacatgtataatatgctacttggaaatgtatcacagccatctctgggatttgaaatatccagacttgtagggaagaaaacaatgacttgacgaccttaaaaagggttagattgacattgcaggaagccaggatgt

SEQ ID NO: 107931 - DNA, 1264 bp, Homo sapiens
  Payload ID: 1186
  Gene Symbol: ANO3
  Gene Name: anoctamin 3
  ENST ID: ENST00000531646
  CDS Start-End: 156-776
gcgtagcctggagagcgaagtgccggctacagcaggtgtcggattgcagtgcgctcgctgaggctccggaccttggagcgtctagagtctggctactgttcctccgcctccctctcgggcagctccctaagccggctgggacgcgcagagtgaaaatggtccaccattcaggctccattcagtcctttaaacagcaaaaaggtatgaatataagcaagagtgagataacaaaagaaacttcgttaaaaccgtctcggagatccctgccttgcctcgcccagagctacgcttactcaaagagcttgagccagtctacttccctcttccagtcaaccgagagtgaatctcaggctcccacatctataaccttaatctccactgacaaagcagagcaagttaatactgaggagaataaaaacgactctgtgctgagatgttcatttgctgacctcagcgatttttgtttggccctaggaaaagataaggattacacggatgaatcagaacacgctacttatgaccgatctcgtctcattaatgactttgttatcaaagataaatctgaattcaagacaaaattatctaagaatgacatgaattacatagcatccagtggacctctgttcaaagatggcaaaaagagaattgattacatcttggtttatagaaagacaaatatacaatatgataaaagaaacacatttgaaaagaacctcagagcagaaggcttgatgttggagaaggaggtaggtgctttactattattagttatgtgataaaatgtgttggaacagatataatcacttatggtttagaaagaaaaatatgtatcacatgactttataaaatacatagtttttttctaacaaatgttaaataaatacatgcacatagccctattaaatatgtattcactttttaatctatataattctgtacaatttaagtattttcaaagggcatgactatttttgcaattttaaaaactgaataaggaatgattatagttatgtcaagtagaaaactttatgaaaaggaaaataacattttgaaagaaaagaatttgccaaacgattaatgtctgttttttagtgctggaactatgagtggttttcttcccaaatctttttcttttgtgagtttttaaaaaaatgttcttggaagaatttattttttgtagtgaaacaataaaagtagcaagactcactagaaaaaaaatagaaagaaggaaaagcgtatcctccataatcctagtatcagagaa

SEQ ID NO: 107932 - DNA, 3509 bp, Homo sapiens
  Payload ID: 1187
  Gene Symbol: ANO4
  Gene Name: anoctamin 4
  Uniprot ID: Q32M45
  ENST ID: ENST00000392977
  CDS Start-End: 211-3078
tttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagaaggaggtgtggatttgcaaggctaccagctggatatgcaaatactacctgacgggccaaagagtgatgtggacttttcagagattcttaatgcaatacaagaaatggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaatt

SEQ ID NO: 107933 - DNA, 3909 bp, Homo sapiens
  Payload ID: 1187
  Gene Symbol: ANO4
  Gene Name: anoctamin 4
  Uniprot ID: Q32M45
  ENST ID: ENST00000392979
  CDS Start-End: 362-3124
ctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagtggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttcagctg

SEQ ID NO: 107934 - DNA, 571 bp, Homo sapiens
  Payload ID: 1187
  Gene Symbol: ANO4
  Gene Name: anoctamin 4
  ENST ID: ENST00000546991
  CDS Start-End: 539-571
tttcactccggctcgctctccggagagtcctgttccagacttctcagggtttttacagcacaaacaactgcatacggcccgaggggaggctgaaaaggacttgtgtgtggtggttttattgcctgtcatcactttgctggcctcctcccgactggagcctggaggttcacagtggatttctttctgccgaagacaccaaggcactgaggaaggatcccttctccttctgttgactctttctatttttatggctccagctcattcctggctttagttgaacttttctgacattcttcatatagcatgcagtccagtggaccttcttctgctgagagcagtattgctggccaggctgtctgggttcaaagctaggctgtgcctcataaacatgacctttggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatgga

SEQ ID NO: 107935 - DNA, 1385 bp, Homo sapiens
  Payload ID: 1187
  Gene Symbol: ANO4
  Gene Name: anoctamin 4
  ENST ID: ENST00000549155
  CDS Start-End: 499-1071
atggcctccctcaccgcatacgacaaagatgtgagcagcggaagttataacctttcctctgcaacgacgggcagctactacagttgtgtcagccagatcaccataggttatgacgttgcggggcctgtggcaattgggcttacccactggaaaaatccatacgtacaaggcagaccaaccctcccatcagatctgcctctcttcgtctccaaagatgcaggcatccctgtgtaccaccgatccttcacccgcaagactgaccaggccacacctttgtcctgtccagcctcactgtctatcactccagtgccttcttacagcagtagcagccaggaaaccctgagtcaagacacaacaggtttaagtttatctattcatggggctgaaaagcgtttgcaaatccatcaacggcgaagtgtggcaagccgcccagcgtcacgtcgtcgcctgcctgtggtcaggcattcctcactcccaccaggcagaaggtcaataaaaatggaggcaagctcttctggaatcactaatggaaaaaccaaagtcttccacccagaaggaggtgtggatttgcaaggctaccagctggatatgcaaatactacctgacgggccaaagagtgatgtggacttttcagagattcttaatgcaatacaagaaatggccaaggatgtcaatattctttttgatgaattagaagctgtcagcagtccttgcaaagatgacgattctcttcttcaccctggaaacctgactagtacttcagatgatgccagcagattggaagccgggggagagacagtgccagaaagaaacaaatcaaatggactttactttcgagatggaaagtgtcgaattgactacatccttgtgtacagaaaatccaacccccagactgaaaagagagaagtatttgaaagaaacattagagcagaaggattgcaaatggagaaagagtcctctctaataaatagtgacattatctttgtgaagttgcatgccccatgggaagtccttggaagatatgcagaacaaatgaatgtaagaatgcctttcagttcaaactgtaactgacgatgggttttcttctcgactggcttcatttttgctgttcttccaggagaaaaatctattacctgccccgccgttacaagttcatgagcaggatcgataaacaaataagcaggtttcggagatggttacctaagaagccaatgaggctggacaaggagacactgccagacctggaggagaatgactgctacactgcccctttcagccagcaaaggatccatcacttcatcatacacaacaaagaaacgttcttcaacaatgccacaagaagtagaatcgtgcatcacattttacaaagaataaaatatgaagaa

SEQ ID NO: 107936 - DNA, 2293 bp, Homo sapiens
  Payload ID: 1187
  Gene Symbol: ANO4
  Gene Name: anoctamin 4
  Uniprot ID: Q32M45
  ENST ID: ENST00000550015
  CDS Start-End: 95-1522
aacaataccttcctggtcctaaatataactatatccatacacatatgtaacccacctttttgacaatggagccactgtcttctttgctgttttcatggcagtctgggcaacagttttcctggagttttggaaaagacggcgagcagtaattgcttatgactgggatttgatagactgggaagaagaggagatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatgg

SEQ ID NO: 107937 - DNA, 961 bp, Homo sapiens
  Payload ID: 1187
  Gene Symbol: ANO4
  Gene Name: anoctamin 4
  Uniprot ID: Q32M45
  ENST ID: ENST00000573650
  CDS Start-End: 1-530
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaatt

SEQ ID NO: 107938 - DNA, 1301 bp, Homo sapiens
  Payload ID: 1187
  Gene Symbol: ANO4
  Gene Name: anoctamin 4
  Uniprot ID: Q32M45
  ENST ID: ENST00000575847
  CDS Start-End: 1-530
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatgg

SEQ ID NO: 107939 - DNA, 1315 bp, Homo sapiens
  Payload ID: 1187
  Gene Symbol: ANO4
  Gene Name: anoctamin 4
  Uniprot ID: Q32M45
  ENST ID: ENST00000570509
  CDS Start-End: 1-530
tctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatgattaatgcttgtataatgtgatgcaataaaatttaaaataaatttctgcacatggaatattttcagctg

SEQ ID NO: 107940 - DNA, 6651 bp, Homo sapiens
  Payload ID: 1188
  Gene Symbol: ANO5
  Gene Name: anoctamin 5
  Uniprot ID: Q75V66
  ENST ID: ENST00000324559
  CDS Start-End: 318-3059
agagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggggaaaaagtcaataagcatatagactactctttccaaatgagtgagcagagcctgagcagcagagagaccagctttctcatcaatgaagaaacaatgcctgcaaagcgattcaatttgttcctgaggcggcggcttatgtttcaaaaaaatcagcaaagcaaagattctatcttcttccgagatgggattaggcaaattgattttgtgctttcctacgttgatgatgtaaagaaagacgcagagttaaaggcggaaagaagaaaagagtttgaaactaatctcagaaaaacaggtcttgagttggaaatagaagacaaaagggactcggaagatggaagaacttattttgtcaagatccatgccccttgggaggtattagttacctatgctgaagtcttgggaatcaaaatgcctattaaggagagtgatattccccgccctaagcacactcctataagctatgtgcttggacctgtaagactcccactgagtgtgaagtatccccatcctgaatattttactgcacaattcagcagacatcggcaggagctcttcctcatcgaagatcaggcaaccttctttccatcctcatcaagaaacagaattgtgtactatattctctcaagatgtccttttggcatagaagatgggaagaaaaggtttgggattgaaagactgctaaactctaacacttactcatctgcctatccactccatgatggccaatattggaagccatcagaacctcccaatcctaccaatgaaagatacacacttcaccagaattgggctcgattttcctatttctacaaggagcagcctttagacttgattaagaattattatggagaaaaaattggtatctattttgtctttcttggattttacacagaaatgctattctttgcagctgtagttggcttagcttgttttatttatggcttattatcaatggaacataacacaagcagcactgaaatctgtgaccctgagattggtggtcagatgatcatgtgcccactctgtgatcaagtgtgtgattattggagactaaatagtacgtgtttggcttcaaagttctcccatttgtttgataatgagtcaacagtgttctttgcaatattcatgggaatttgggtcaccttatttttggagttttggaaacaacgacaagccagactggaatatgaatgggacctggtggactttgaagaggaacagcagcagcttcagctgagaccagaatttgaagctatgtgtaaacacaggaaattgaatgcagtgactaaggagatggaaccttacatgcctctatacacgcgtattccatggtactttctttcaggagccacagtgacattatggatgtctcttgtcgtcaccagtatggtagctgtaattgtgtaccgcctgtcagtctttgctacatttgctagtttcatggaaagtgatgcatccttaaagcaggtcaaaagcttccttactcctcagataaccacatcactcacaggatcatgcttgaactttattgtcatcttgatcttgaatttcttttatgaaaagatatctgcctggatcacaaaaatggaaattcctcgaacataccaggagtatgagagcagtcttaccttgaaaatgttcctgtttcagtttgtaaatttttactcatcctgcttctacgtagctttctttaaagggaagttcgtaggctatcctggaaaatacacatatttatttaatgagtggagaagtgaagagtgtgatcctggaggctgtcttatagaattgacaacccaattgaccattataatgaccgggaaacagatttttggaaacattaaagaagccatttatcccttggctttgaattggtggagacgccgaaaagctcggacaaactctgagaagctgtatagtcgatgggagcaggatcatgaccttgaaagttttggaccccttgggcttttctatgagtacttagaaacagttactcaatttggatttgttacactatttgtggcctcttttcctttggctcctcttcttgctctcataaataatattgtagagattcgagtggatgcctggaaacttaccactcaatacaggagaactgtagcttctaaagctcatagcataggtgtttggcaagacattctttatggaatggctgtcctttctgttgcaactaatgcctttattgttgcatttacgtcagacatcattccccgtctagtttactactatgcttactcaacaaatgccacacagcctatgacaggatatgtgaataatagcctgtcagtattcctgatagctgattttccaaaccacactgcaccttcggaaaaacgagacttcatcacttgcaggtacagagattacagatatcctcctgatgacgagaataaatattttcataatatgcaattctggcatgtccttgctgccaagatgaccttcatcattgttatggaacatgttgtgtttttagttaaatttttgctggcctggatgatacctgatgttccaaaagatgttgtggagagaatcaagagagaaaagttaatgactatcaagattctccatgattttgagctcaacaaattaaaagagaacttgggaattaattctaatgaatttgccaagcatgtcatgattgaggaaaacaaagcacagctggctaaatcaacactctaatcagtatagtgaggaagcagcaggtgatctgccttacttcactttatcctctggttttagggccagacgccagaagccatgtgtcaattttaccctttcttttttttttttttctttttttttttaaactcaaagtttttatacacttttatagaggccaactttgtgatgttggaaatgtactacttctctgcttcattgactgggccctctccagatgttgttttctgaggtgctgtaaatgactgttgaaagtgcaggtagaatcagaatactgggaaattatggagtcttgcagtttagtaagaaacactggccttgggctgtcccatcactttccagtgcatctatttatttttgtggtcttctcttgggttatttgatacctccttccccattaagaaaaatgttggggcaaaaagaaatggatcaaagagactgactgagccctatatatcctatcattttaaaatatgcaaatgaattgccaagatcagatgacataagaaaactcacacattaaggtgttaatgtatcatagcagaggtttattcctaacacattcaactaccatcagaatcccagatagttcttcctggtaaaggcagaattccttttctcgagactgaaattttgggtttcaacataaaacaacttggttcttagagataataatttggttataatagtttcaagactgatcttatctggaaagcaacattatgaagctgttagattgcttcaggttctcaagcaaagacacaatacagaagtaaatgtgttttcttagtagttaatggatgcaggacaatgtatattgattaatttgttgattttaatttagaaaattgttaaattatttcttaaaaatcacttttcttctggaatgccaatttcacatcatgaagcctttttgtataagttagatacgagttgtttatgataaacatttctttgctttaaaataattgcaaatattttaataagtttacaaccttttctattgatgtatcatcttatacaatgctcagtgccttgttccaatacctctgacacacaagaagtcatgttgttagctagtgatttgatgtgatgtaacatcttaaatgtaagcttgtcttaatgaaattgtcagtgtaataacaactacagtcttgaaaaccaaaagtgaatcaaccaactaagaatgagttcatggacttaataatctaagggggaaaaaatgtttgttgaattattcctctcaaatttaggcttgtgttacatgcacaaaaatccttgttctgttttcacttaaaaaaactaaatatgtataactttgtgtatacacacacacacatctatatatataattattagcactagagggatatagtccagttatgtagtatttaaatctccagtttcaaattataattcacctccaaaagaatagttttttaatcacacacataagaaattttatcacaatatttaaaactaatatttcattatctaatgctaataaattattgtggtactgccagtattaaatatatggcagatggtattaactactgatcaatagtaagcatacagaactggggattatggattttataaactatgagacagtcaccccagtttggactgggactaatccccagtactgatttgtcatccactgagtagactttatgaatattttgggtaatttgaaatgatctcattattgaaagatgatttcatatgtagagaagataatatttctttcttgaaaaaacaagtcaggcttaccatgatgtgtgcaaccaatgtaggatctttggcttgtcaaatcagattctccattgctatagtgtacagtgcacacagctcatattgcttccttcctgggtgctgataaaaataagaaagagcatggaaattggtttcttgaatataagctttaatttttaaggcttaaaagtattcatagaggtagactgtatgataaataaaaacaaatttaattcacaaagttatctgtacactgcagttttaaaatataccaactaaattattgggtttctggaagtgaatggagaaaacagcaagggaagaaatcgtttttaagataagtaaataattcccatggattgataaatattttccttttaaaatgttatggactgatattttttattcacctttaaatttcttatcaagaagtttatctttgtttttcagatttaaaaatgaaatacaggtattcgtcactttcctgaaaccatgctaaccaaaatcagtagccaaaccaattcagatagatgtgtctcatctaattaaacccattggtttttatgggagggctgcattaagagcacccaaccaccacatgtaagttgataattaccagcatggcaggtgattttatctgctgaccaagcgcatagttttgttttgttttcagaatgttctagggaacatttgagattttatgtgaaataaaattttaagtgccaaagccaaaaaaatacttaactcttttcaaaggccctctttcatccttgccttcgtcaactttcctttgcacacaggaagcaaaatctacttcaagacatttattttagaggaatccattaagaaaggattgttttacttaaatgaaatgctgtcttatttttgctgtgtcttttgacacctcttagctttaacattcttcttttaaccaagccattatgcaaagttatcaaagaagaggagaaggaaaggaggacagatgaaagtgacgggaaatgagaaagaagaggagtgaggaaacagttatttccttatgaatcctgtgtgtttctttggaagaaagagctgttccgaggaagtttggtccagctgtggttgataagaggtatatctcttaaaaaagacacctaatgaaagtgagagaaaagctaaagaaaatttcaatgtgaccactattatgtgtcaaaataaaacttagattccaaagtggttttgtagtgttgggtgctatgagtaggtatggatctctgttgattgactccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccagccttacaagtcagccacaatgagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttccaggaagagaaatatgcagttatgcaggaaaagctctcttaaataatgtgtacataaatctcaagagaatcaaattcacagagtgaataaagtaataatattaaactaca

SEQ ID NO: 107941 - DNA, 5975 bp, Homo sapiens
  Payload ID: 1189
  Gene Symbol: ANO6
  Gene Name: anoctamin 6
  Uniprot ID: Q4KMQ2
  ENST ID: ENST00000320560
  CDS Start-End: 203-2935
gagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 107942 - DNA, 3558 bp, Homo sapiens
  Payload ID: 1189
  Gene Symbol: ANO6
  Gene Name: anoctamin 6
  Uniprot ID: Q4KMQ2
  ENST ID: ENST00000425752
  CDS Start-End: 303-3092
cttctgcgcgcctcgtaaaaccggggaagttcaatcattccgcagcgagccgcggcggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagtatctcgctttgttgcccaggctgggacacagtggcatgatcttggctcactgcaacctccgcctcccagttgactgctgtatgtgttataggtttgtcgatgaaattagacttttggaacaactaacttctgactttattgactccctctattatatattttctatttcaataatatctattttcttttctgttactttctttttccttctactttctttggggccaactccgtgtttttctgtatcgaatttcttaagttagatttattcaataattcattcaacaaatatttgtgtgtctattatgtggccagcattgtttcatgtgctcaagatagagtagcattgtttggctcattaatattccaatactggcatttaagaccattaattttcctctaaatcgtatttgagctgcaacccacaagcttttatatgtatagttttttgttgttgctattattaaaagtattttagatcctcccttgttttgcttttcaatctgaaatgccttcatgccattttaatttttaaaaggtaatttaattgagcctaatttctttttcttttttcttttttttgagacagagtcttactctgtcacccaggctggagtgcagtggcgtgatctcagctcaatgcaagctctgcctcccaggttcacgccattctcctgtctcagcctcccaagtagctgggactacaggcgcccaccaccatgcctggct

SEQ ID NO: 107943 - DNA, 5504 bp, Homo sapiens
  Payload ID: 1189
  Gene Symbol: ANO6
  Gene Name: anoctamin 6
  Uniprot ID: Q4KMQ2
  ENST ID: ENST00000423947
  CDS Start-End: 238-3033
gggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggtgatgttcctgcctccaggaggccttttctgactcctcatactcacctcccatccagcctggtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggca

SEQ ID NO: 107944 - DNA, 5955 bp, Homo sapiens
  Payload ID: 1189
  Gene Symbol: ANO6
  Gene Name: anoctamin 6
  Uniprot ID: Q4KMQ2
  ENST ID: ENST00000441606
  CDS Start-End: 237-2915
ttggggcagaggaggcttgtaggaataggggaagagttcataagcagagctgaaacaacaccaaacatggaaatgttacaaggtggagaaattgtgcttactgaaactcttctcagaaatattgctgtttgtggatgatagaaatcttcagagttgtcacttaaggtagaggtaggagggtaagaagcgtcaaggactcaccgaattgtccattcccccttttgttctgctgtggaatgttttgtgctgctgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatggagagaagattggaatctactttgcttggctgggctattacactcagatgcttctcctggccgcagttgtaggagtggcttgctttctctatggatatcttaatcaagataactgtacatggagcaaagaagtttgtcatcctgatattggtggcaagatcataatgtgtcctcagtgtgataggctttgtccattctggaaactcaatattacttgcgagtcctcaaagaaattgtgcatcttcgacagttttggaaccctggtctttgcagtatttatgggagtatgggttaccttgtttttggagttttggaagcgacgccaggcagaacttgagtatgaatgggatactgttgagttacagcaggaagaacaagcccgaccagaatacgaagcacgatgtactcacgtagtgataaatgagattactcaggaagaagaacgcattccctttactgcctggggaaaatgtatacggataaccctctgtgccagtgctgtctttttctggatcctattgatcatcgcttcagttattgggatcattgtctataggctctcggtgttcattgtattttctgcaaaacttcccaagaacattaatggaacagacccaatccagaaatacctgactccacagacagccacgtccatcacggcctccatcatcagctttataattatcatgattctgaacaccatatatgaaaaagtggcaattatgattactaacttcgaactcccaaggacccagactgattatgagaacagcctcaccatgaagatgttcttattccagtttgtcaactactactcttcatgcttctacatagcattctttaagggcaaatttgtaggctatccaggagacccagtttattggttgggaaaatacagaaatgaagagtgtgacccaggtggctgtcttcttgaactgacaactcagctgacaataatcatgggaggaaaagcaatctggaataacatacaagaagtattattgccctggatcatgaatctaattgggcgatttcacagagtttctggatcagaaaagataaccccacgatgggaacaggactaccatctgcagcctatgggcaaactgggattattttatgaatatcttgaaatgattattcagtttgggttcgtcaccttatttgtggcctcttttccactggcccctctgttggctctcgtgaacaatatattggaaataagagtggacgcatggaaactgaccacccagtttagacgcctggtaccagagaaagcccaagacattggagcatggcagcccatcatgcaaggaatagcaattctggctgtggtgaccaatgccatgatcatagctttcacgtcggacatgatcccccgcctagtgtactactggtccttctccgtccctccctacggggaccacacttcctacaccatggaagggtacatcaacaacactctctccatcttcaaagtcgcagacttcaaaaacaaaagcaagggaaacccgtactctgacctgggtaaccataccacatgcaggtatcgtgatttccgatacccacctggacacccccaggagtataaacacaacatctactattggcatgtgattgcagccaagctggcttttatcattgtcatggagcacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggaggggaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaata

SEQ ID NO: 107945 - DNA, 835 bp, Homo sapiens
  Payload ID: 1189
  Gene Symbol: ANO6
  Gene Name: anoctamin 6
  ENST ID: ENST00000550630
  CDS Start-End: 203-340
gagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgggctgaagtgcagtagtggagtagcgcaatcatggctcactgtagcattgactcccagactcaattgatcctcttacctcaacctcctgcgtatctgggaccacaggtgatgttcctgcctccaggaggccttttctgactcctcatactcacctcccatccagcctggtgttggaaaaccttggacagacaattgtccccgatttgggatcactggaaagtcagcatgattttcgaaccccggagtttgtgaaagctattctgaaggttgccctaggaagttgaacataagatggactccagggaattagaaaccctgtttttccatgcaaccctgctctcagacctctgtggacaagtcgcttttccttttagaacctcagtttcctcatatgtaaaaagcagaaagatcagcagtagatatcctcactggagtgttgttcagtgactgcacggtgactgagaaacattttagctatcttaaaatgatgttcataataatatagtgaatagtcttatctaacatttatggatgcttgtggttggctaagcacattacaggg

SEQ ID NO: 107946 - DNA, 4128 bp, Homo sapiens
  Payload ID: 1190
  Gene Symbol: ANO7
  Gene Name: anoctamin 7
  Uniprot ID: Q6IWH7
  ENST ID: ENST00000274979
  CDS Start-End: 104-2905
aaagatagatcctgctccaggagccgggaagccttgccctggccagctgtgctgggcacctcccctgcctgcttcctggcccacttgcaggcaaggtgagggcatgcgaatggctgccactgcctgggcggggctccaagggccacccctccccaccctctgtcccgcagtgaggacgggactctactgccgagaccaggctcacgctgagaggtgggccatgacctccgagacctcttccggaagccactgtgccaggagcaggatgctgcggcgacgggcccaggaagaggacagcaccgtcctgatcgatgtgagcccccctgaggcagagaagaggggctcttacgggagcacagcccacgcctcggagccaggtggacagcaagcggccgcctgcagagctgggagtcctgccaagccccggatcgcagacttcgtcctcgtttgggaggaggacctgaagctagacaggcagcaggacagtgccgcccgggacagaacagacatgcacaggacctggcgggagacttttctggataatcttcgtgcggctgggctgtgtgtagaccagcaggacgtccaggacgggaacaccacagtgcactacgccctcctcagcgcctcctgggctgtgctctgctactacgccgaagacctgcgcctgaagctgcccttgcaggagttacccaaccaggcctccaactggtcggccggcctgctggcatggctgggcatccccaacgtcctgctggaggttgtgccagacgtaccccccgagtactactcctgccggttcagagtgaacaagctgccacgcttcctcgggagtgacaaccaggacaccttcttcacaagcaccaagaggcaccaaattctgtttgagatcctggccaagaccccgtatggccacgagaagaaaaacctgcttgggatccaccagctgctggcagagggtgtcctcagtgccgccttccccctgcatgacggccccttcaagacgcccccagagggcccgcaggctccacgcctcaaccagcgccaagtccttttccagcactgggcgcgctggggcaagtggaacaagtaccagcccctggaccacgtgcgcaggtacttcggggagaaggtggccctctacttcgcctggctcgggttttacacaggctggctcctgccagcggcagtggtgggcacactggtgttcctggtgggctgcttcctggtgttctcagacatacccacgcaggaactgtgtggcagcaaggacagcttcgagatgtgcccactttgcctcgactgccctttctggctgctctccagcgcctgtgccctggcccaggccggccggctgttcgaccacggcggcaccgtgttcttcagcttgttcatggcactgtgggccgtgctgctgctggagtactggaagcggaagagcgccacgctggcctaccgctgggactgctctgactacgaggacactgaggagaggcctcggccccagtttgccgcctcagcccccatgacagccccgaaccccatcacgggtgaggacgagccctacttccctgagaggagccgcgcgcgccgcatgctggccggctctgtggtgatcgtggtgatggtggccgtggtggtcatgtgcctcgtgtctatcatcctgtaccgtgccatcatggccatcgtggtgtccaggtcgggcaacacccttctcgcagcctgggcctctcgcatcgccagcctcacggggtctgtagtgaacctcgtcttcatcctcatcctctccaagatctatgtatccctggcccacgtcctgacacgatgggaaatgcaccgcacccagaccaagttcgaggacgccttcaccctcaaggtgttcatcttccagttcgtcaacttctactcctcacccgtctacattgccttcttcaagggcaggtttgtgggatacccaggcaactaccacaccttgtttggagtccgcaatgaggagtgcgcggctggaggctgcctgatcgagctggcacaggagctcctggtcatcatggtgggcaagcaggtcatcaacaacatgcaggaggtcctcatcccgaagctaaagggctggtggcagaagttccggcttcgctccaagaagaggaaggcgggagcttctgcaggggctagccaggggccctgggaggacgactatgagcttgtgccctgtgagggtctgtttgacgagtacctggaaatggtgctgcagttcggcttcgtcaccatcttcgtggccgcctgtccgctcgcgccgctcttcgccctgctcaacaactgggtggagatccgcttggacgcgcgcaagttcgtctgcgagtaccggcgcccggtggccgagcgcgcccaggacatcggcatctggttccacatcctggcgggcctcacgcacctggcggtcatcagcaacgccttcctcctggccttctcgtccgacttcctgccgcgcgcctactaccggtggacccgcgcccacgacctgcgcggcttcctcaacttcacgctggcgcgagccccgtcctccttcgccgccgcgcacaaccgcacgtgcaggtatcgggctttccgggatgacgatggacattattcccagacctactggaatcttcttgccatccgcctggccttcgtcattgtgtttgagcatgtggttttctccgttggccgcctcctggacctcctggtgcctgacatcccagagtctgtggagatcaaagtgaagcgggagtactacctggctaagcaggcactggctgagaatgaggttctttttggaacgaacggaacaaaggatgagcagcccgagggctcagagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtattgatgtccttggagttctacaagtggaacttaagtgtcaaaaagaatatgtggtttttagctgagcgtggtggctcacacctgtaatcccaggactttgggaggctgaggcaggaggattacaaggtcaggagttcgggactagcctgtccaacatggtgaaaccctgtctttactaaaaatgcaaaaatt

SEQ ID NO: 107947 - DNA, 894 bp, Homo sapiens
  Payload ID: 1190
  Gene Symbol: ANO7
  Gene Name: anoctamin 7
  Uniprot ID: Q6IWH7
  ENST ID: ENST00000402530
  CDS Start-End: 104-643
aaagatagatcctgctccaggagccgggaagccttgccctggccagctgtgctgggcacctcccctgcctgcttcctggcccacttgcaggcaaggtgagggcatgcgaatggctgccactgcctgggcggggctccaagggccacccctccccaccctctgtcccgcagtgaggacgggactctactgccgagaccaggctcacgctgagaggtgggccatgacctccgagacctcttccggaagccactgtgccaggagcaggatgctgcggcgacgggcccaggaagaggacagcaccgtcctgatcgatgtgagcccccctgaggcagagaagaggggctcttacgggagcacagcccacgcctcggagccaggtggacagcaagcggccgcctgcagagctgggagtcctgccaagccccggatcgacttcgtcctcgtttgggaggaggacctgaagctagacaggcagcaggacagtgccgcccgggacagaacagacatgcacaggacctggcgggagacttttctggataatcttcgtgcggctgggctgtgtgtagaccaggtacgtggaggctgtcatgggcagggccctaggccctgcatccactcagtgacccatgaccttgccgcatgaggcctgagggcatggtgtccagagtcccagagcagatcaggccccaaagtcctgctggaccccccagccaccgtgagctcctccgtgtggctagggagctgctgtccagaggcggaggtaaacattgatccctcctgcacactcagctctctcatggaagtcggagccctcagggtcacctgaaaactctgacactacctttgccattcacctgtcccgtctccaacattaaagcttttgggtaggcgtgt

SEQ ID NO: 107948 - DNA, 2652 bp, Homo sapiens
  Payload ID: 1190
  Gene Symbol: ANO7
  Gene Name: anoctamin 7
  Uniprot ID: Q6IWH7
  ENST ID: ENST00000402430
  CDS Start-End: 1-2652
atgcgaatggctgccactgcctgggcggggctccaagggccacccctccccaccctctgtcccgcagtgaggacgggactctactgccgagaccaggctcacgctgagaggtgggccatgacctccgagacctcttccggaagccactgtgccaggagcaggatgctgcggcgacgggcccaggaagaggacagcaccgtcctgatcgatgtgagcccccctgaggcagagaagaggggctcttacgggagcacagcccacgcctcggagccaggtggacagcaagcggccgcctgcagagctgggagtcctgccaagccccggatcgacttcgtcctcgtttgggaggaggacctgaagctagacaggcagcaggacagtgccgcccgggacagaacagacatgcacaggacctggcgggagacttttctggataatcttcgtgcggctgggctgtgtgtagaccagcaggacgtccaggacgggaacaccacagtgcactacgccctcctcagcgcctcctgggctgtgctctgctactacgccgaagacctgcgcctgaagctgcccttgcaggagttacccaaccaggcctccaactggtcggccggcctgctggcatggctgggcatccccaacgtcctgctggaggttgtgccagacgtaccccccgagtactactcctgccggttcagagtgaacaagctgccacgcttcctcgggagtgacaaccaggacaccttcttcacaagcaccaagaggcaccaaattctgtttgagatcctggccaagaccccgtatggccacgagaagaaaaacctgcttgggatccaccagctgctggcagagggtgtcctcagtgccgccttccccctgcatgacggccccttcaagacgcccccagagggcccgcaggctccacgcctcaaccagcgccaagtccttttccagcactgggcgcgctggggcaagtggaacaagtaccagcccctggaccacgtgcgcaggtacttcggggagaaggtggccctctacttcgcctggctcgggttttacacaggctggctcctgccagcggcagtggtgggcacactggtgttcctggtgggctgcttcctggtgttctcagacatacccacgcaggaactgtgtggcagcaaggacagcttcgagatgtgcccactttgcctcgactgccctttctggctgctctccagcgcctgtgccctggcccaggccggccggctgttcgaccacggcggcaccgtgttcttcagcttgttcatggcactgtgggccgtgctgctgctggagtactggaagcggaagagcgccacgctggcctaccgctgggactgctctgactacgaggacactgaggagaggcctcggccccagtttgccgcctcagcccccatgacagccccgaaccccatcacgggtgaggacgagccctacttccctgagaggagccgcgcgcgccgcatgctggccggctctgtggtgatcgtggtgatggtggccgtggtggtcatgtgcctcgtgtctatcatcctgtaccgtgccatcatggccatcgtggtgtccaggtcgggcaacacccttctcgcagcctgggcctctcgcatcgccagcctcacggggtctgtagtgaacctcgtcttcatcctcatcctctccaagatctatgtatccctggcccacgtcctgacacgatgggaaatgcaccgcacccagaccaagttcgaggacgccttcaccctcaaggtgttcatcttccagttcgtcaacttctactcctcacccgtctacattgccttcttcaagggcaggtttgtgggatacccaggcaactaccacaccttgtttggagtccgcaatgaggagtgcgcggctggaggctgcctgatcgagctggcacaggagctcctggtcatcatggtgggcaagcaggtcatcaacaacatgcaggaggtcctcatcccgaagctaaagggctggtggcagaagttccggcttcgctccaagaagaggaaggcgggagcttctgcaggggctagccaggggccctgggaggacgactatgagcttgtgccctgtgagggtctgtttgacgagtacctggaaatggtgctgcagttcggcttcgtcaccatcttcgtggccgcctgtccgctcgcgccgctcttcgccctgctcaacaactgggtggagatccgcttggacgcgcgcaagttcgtctgcgagtaccggcgcccggtggccgagcgcgcccaggacatcggcatctggttccacatcctggcgggcctcacgcacctggcggtcatcagcaacgccttcctcctggccttctcgtccgacttcctgccgcgcgcctactaccggtggacccgcgcccacgacctgcgcggcttcctcaacttcacgctggcgcgagccccgtcctccttcgccgccgcgcacaaccgcacgtgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtga

SEQ ID NO: 107949 - DNA, 555 bp, Homo sapiens
  Payload ID: 1190
  Gene Symbol: ANO7
  Gene Name: anoctamin 7
  ENST ID: ENST00000451047
  CDS Start-End: 1-555
cgcggggggcgcgttccgagggctgagggcggacggtggcggagagcccggccgtgaccccctccccgcagtgctgcagttcggcttcgtcaccatcttcgtggccgcctgtccgctcgcgccgctcttcgccctgctcaacaactgggtggagatccgcttggacgcgcgcaagttcgtctgcgagtaccggcgcccggtggccgagcgcgcccaggacatcggcatctggttccacatcctggcgggcctcacgcacctggcggtcatcagcaacgccttcctcctggccttctcgtccgacttcctgccgcgcgcctactaccggtggacccgcgcccacgacctgcgcggcttcctcaacttcacgctggcgcgagccccgtcctccttcgccgccgcgcacaaccgcacgtgcaggtatcgggctttccgggatgacgatggacattattcccagacctactggaatcttcttgccatccgcctggccttcgtcattgtgtttgagcatgtggttttctccgttggccgcctcctggacctcctggtgcc

SEQ ID NO: 107950 - DNA, 4152 bp, Homo sapiens
  Payload ID: 1191
  Gene Symbol: ANO8
  Gene Name: anoctamin 8
  Uniprot ID: Q9HCE9
  ENST ID: ENST00000159087
  CDS Start-End: 160-3858
cgagaagcagcgctcgggcgagcgaggaccgaggccggcgcgggcgggcgcggcctttgtctcctcctcccgcgcgctccgcggctgcaccggccccatgagcccgcggctccccgtcgcccgggccgtccgtagcccctgacctgacctgtcctcgccatggccgaggccgcctccggcgccgggggcacgtccctggagggcgagcgtggcaagaggcccccgccggagggcgagcctgcagccccggcgtccggagttctggataagcttttcggaaagcggctcctgcaggctggtcgctacctggtgtcccacaaggcgtggatgaagacggtgcctacagagaactgcgacgtgctgatgaccttcccagacacgaccgatgaccacacgctgctatggctgctgaaccacatccgcgtgggcattcccgagctcatcgtgcaagtccgccaccaccgccacacgcgtgcctacgccttctttgtcaccgccacgtatgagagcctactccgaggggccgacgagctgggtctgcgcaaagcagtgaaggccgagtttggcgggggcacccgcggcttctcctgcgaggaggactttatctatgagaatgtggagagcgagctacgcttcttcacctcccaggaacgccagagcatcatccgcttctggctgcagaatttgcgtgccaagcagggagaagcactccacaacgtgcgcttcctggaggaccagccaatcatcccggagctggcagcacgtgggatcatccagcaggtgttccctgtccacgagcagcgtattctgaaccgcctcatgaagtcatgggtgcaggccgtgtgtgaaaaccagcctctagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagatgctggccacgctgctgatcacccgccagttcctccagaacgtgcgcgaggtcctgcagccgcacctgtaccggcgcctgggccgcggcgagctgggcctgcgggccgtctgggagctggcccgagccctgcttggcctcctgagcctccggcgccctgcgccccgccgcctcgaaccccaggcggatgagggcgggggcggcggcagcgggggcgggggccgcaggtgcctcagcgggggctgcggggcgccggaggaggaggaggaggcggcgctggtggagcggcggcgggcgggggaaggcggggaggagggggacgggcctccagggggcaaggaggaggacgaggacgacgaggaggaggaggacgaggaggaagaggaggacgaggaggagggcgaggaagggggcctcctggactgcgggctccggctgaagaaggtcagcttcgctgagcgcggcgcggggcggcgtcggcccggcccaagcccggaggccctcctggaggaagggagccccactatggtggagaaggggctggagccgggagtgttcaccctggccgaggaggacgacgaggcggagggggctcccggcagccctgaacgggagcccccggccatcttgttccgccgggccgggggcgagggccgagaccaggggcccgacgggggcccggacccggaacccggctccaacagcgattcgacccgtaggcagagacggcagaaccggtcgtcttggattgacccgccggaggaggaacactcgccccagctcacccaggcagagctggagagctgtatgaagaagtacgaggacacgttccaggactaccaggagatgttcgtgcagttcggctacgttgtgctcttctcgtccgccttccccctggcggcgctgtgcgccctggtcaacaacctcattgagatccgcagcgacgccttcaagctgtgcaccgggctgcagcggcccttcggccagcgcgtggaaagcatcggccagtggcagaaggtgatggaggccatgggtgtcctagcgattgtggtcaactgctacttaatcggccagtgcgggcagctgcagcgcctcttcccctggctgagcccggaggcagccatcgtgtcggtggtagtgctcgagcacttcgctctgctcctcaagtacctcatccacgtggccatccccgatatcccgggctgggtggccgaggaaatggccaagctggagtaccagcgccgcgaggcctttaagagacacgagcgccaggcccagcatcgctaccagcagcagcagcgcaggcggcgggaggaggaggagcgacagcgccatgcagagcaccatgcccggcgggagcatgattctggtggccgagaggaggcgagggccgagggctctgggctggaccctgccacctcctccgagaaggcctctgccaaggccaagggcagcactgcgggtggccacgggcctgaacggcccaagcgcccagggtccctgctggcacccaacaacgtcatgaagttgaagcagatcatcccactgcagggcaaattcctctcgtcaggggccacatcctcactggctgctgcaggggccggagccaccacccggcctccccctgcccagtcacccacaggcagcgacacccgcctgcctgccttcctcagcttcaagttcctcaagtcacccgagacccggcgggactctgagcgcagccactcaccgcccaaagccttccatgctggcaagctcttcccctttggtggcacccgggctgagcctgggtccaacggggcgggcgggcaggcccggccagatgggacccccagcagtggcagcagccgggttcagaggagtgggccggtggacgaggccctggctgaggagctggaagccccccggcccgaagaggaaggctcagggacagcgctggcccccgtgggcgcccctgccctccgcacccgccgcagccggagccccgcgccgccgccgccaatgccgctgccccggcccccgacaccgcccgcaggctgctggcagtgggacgggccctggggctgcgggggcgagggtgccgccccccgccaggccctggccgctgccgagtgcccaccctgtgccatggccgggcccccacccgccccccagcccctgccgggagacgccagcttttacagcctcccgcccccaccgctaccgcccacctcggatcccctcgagaccccagcgccctcccctagccccagccccagcccccaggccgtgtgctggcccagcggctggcattagctctacccgccctgccttctcttctcatatgcaatatcagtcattcacaggggcggccggtctccaaaatgcaaaatgcgcttcagcccccgagggcccccagtattggtcggtgccccccatctgccgttttcctttccaaacgaaaggaaacccacaaatccaacagaaaacacacacacacacacacacacacacacacacagaacaggcgattatttatttgtttttaatttattttgtcatatttttgtaaaacggcagaaatgcaataaaaactatatttcaacagtg

SEQ ID NO: 107951 - DNA, 4618 bp, Homo sapiens
  Payload ID: 1191
  Gene Symbol: ANO8
  Gene Name: anoctamin 8
  ENST ID: ENST00000597643
  CDS Start-End: 68-1813
gccccatgagcccgcggctccccgtcgcccgggccgtccgtagcccctgacctgacctgtcctcgccatggccgaggccgcctccggcgccgggggcacgtccctggagggcgagcgtggcaagaggcccccgccggagggcgagcctgcagccccggcgtccggagttctggataagcttttcggaaagcggctcctgcaggctggtcgctacctggtgtcccacaaggcgtggatgaagacggtgcctacagagaactgcgacgtgctgatgaccttcccagacacgaccgatgaccacacgctgctatggctgctgaaccacatccgcgtgggcattcccgagctcatcgtgcaagtccgccaccaccgccacacgcgtgcctacgccttctttgtcaccgccacgtatgagagcctactccgaggggccgacgagctgggtctgcgcaaagcagtgaaggccgagtttggcgggggcacccgcggcttctcctgcgaggaggactttatctatgagaatgtggagagcgagctacgcttcttcacctcccaggaacgccagagcatcatccgcttctggctgcagaatttgcgtgccaagcagggagaagcactccacaacgtgcgcttcctggaggaccagccaatcatcccggagctggcagcacgtgggatcatccagcaggtgttccctgtccacgagcagcgtattctgaaccgcctcatgaagtcatgggtgcaggccgtgtgtgaaaaccagcctctagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagctcctgctcgtcctgtccctgtcccagagcctcgagcggcagctgcaggcggtgctggtcccgctcgcggccctgcggttccgcctgctcctcctctccctccggggcctcctgctcgcggcccgggccaaagtacgggcaggtggcgagcccgtgggtcctcgccggggtgggcagcgtggctgtgctgggggcctggcgcgccgagctgagggcgcatgcgcggagggaatctggggtcgggggcggccagcaagcaggtgcaggcggctgggggcgcacgcggcccagtgcaccgacagagcccgcggtggggtggagacgcgctgggcctgcccgtgaggtgggcgaggagcgctgcgcgtgccaggctgtattttgtggctgagcgctgggggcctcgcgtcgaggcgcgtccaaagcagcggagttaggaaccggattcggcgtgtgtctgggcacggtgctccggcggggcgcccagggagggtgagtcccccgatcccggcgccccgcttgccccccacgcgcctctctccttccccttcctgcccccagatgctggccacgctgctgatcacccgccagttcctccagaacgtgcgcgaggtcctgcagccgcacctgtaccggcgcctgggccgcggcgagctgggcctgcgggccgtctgggagctggcccgagccctgcttggcctcctgagcctccggcgccctgcgccccgccgcctcgaaccccaggcggatgagggcgggggcggcggcagcgggggcgggggccgcaggtgcctcagcgggggctgcggggcgccggaggaggaggaggaggcggcgctggtggagcggcggcgggcgggggaaggcggggaggagggggacgggcctccagggggcaaggaggaggacgaggacgacgaggaggaggaggacgaggaggaagaggaggacgaggaggagggcgaggaagggggcctcctggactgcgggctccggctgaagaaggtcagcttcgctgagcgcggcgcggggcggcgtcggcccggcccaagcccggaggccctcctggaggaagggagccccactatggtggagaaggggctggagccgggagtgttcaccctggccgaggaggacgacgaggcggagggggctcccggcagccctgaacgggagcccccggccatcttgttccgccgggccgggggcgagggccgagaccaggggcccgacgggggcccggacccggaacccggctccaacagcgattcgacccgtaggcagagacggcagaaccggtcgtcttggattgacccgccggaggaggaacactcgccccagctcacccaggcagagctggagagctgtatgaagaagtacgaggacacgttccaggactaccaggagatgttcgtgcagttcggctacgttgtgctcttctcgtccgccttccccctggcggcgctgtgcgccctggtcaacaacctcattgagatccgcagcgacgccttcaagctgtgcaccgggctgcagcggcccttcggccagcgcgtggaaagcatcggccagtggcagaaggtgatggaggccatgggtgtcctagcgattgtggtcaactgctacttaatcggccagtgcgggcagctgcagcgcctcttcccctggctgagcccggaggcagccatcgtgtcggtggtagtgctcgagcacttcgctctgctcctcaagtacctcatccacgtggccatccccgatatcccgggctgggtggccgaggaaatggccaagctggagtaccagcgccgcgaggcctttaagagacacgagcgccaggcccagcatcgctaccagcagcagcagcgcaggcggcgggaggaggaggagcgacagcgccatgcagagcaccatgcccggcgggagcatgattctggtggccgagaggaggcgagggccgagggctctgggctggaccctgccacctcctccgagaaggcctctgccaaggccaagggcagcactgcgggtggccacgggcctgaacggcccaagcgcccagggtccctgctggcacccaacaacgtcatgaagttgaagcagatcatcccactgcagggcaaattcctctcgtcaggggccacatcctcactggctgctgcaggggccggagccaccacccggcctccccctgcccagtcacccacaggcagcgacacccgcctgcctgccttcctcagcttcaagttcctcaagtcacccgagacccggcgggactctgagcgcagccactcaccgcccaaagccttccatgctggcaagctcttcccctttggtggcacccgggctgagcctgggtccaacggggcgggcgggcaggcccggccagatgggacccccagcagtggcagcagccgggttcagaggagtgggccggtggacgaggccctggctgaggagctggaagccccccggcccgaagaggaaggctcagggacagcgctggcccccgtgggcgcccctgccctccgcacccgccgcagccggagccccgcgccgccgccgccaatgccgctgccccggcccccgacaccgcccgcaggctgctggcagtgggacgggccctggggctgcgggggcgagggtgccgccccccgccaggccctggccgctgccgagtgcccaccctgtgccatggccgggcccccacccgccccccagcccctgccgggagacgccagcttttacagcctcccgcccccaccgctaccgcccacctcggatcccctcgagaccccagcgccctcccctagccccagccccagcccccaggccgtgtgctggcccagcggctggcattagctctacccgccctgccttctcttctcatatgcaatatcagtcattcacaggggcggccggtctccaaaatgcaaaatgcgcttcagcccccgagggcccccagtattggtcggtgccccccatctgccgttttcctttccaaacgaaaggaaacccacaaatccaacagaaaacacacacacacacacacacacacacacacacagaacaggcgattatttatttgtttttaatttattttgtcatatttttgtaaaacggcagaaatgcaataaaaactatatttcaacagtg

SEQ ID NO: 107952 - DNA, 1905 bp, Homo sapiens
  Payload ID: 1191
  Gene Symbol: ANO8
  Gene Name: anoctamin 8
  ENST ID: ENST00000630631
  CDS Start-End: 160-1905
cgagaagcagcgctcgggcgagcgaggaccgaggccggcgcgggcgggcgcggcctttgtctcctcctcccgcgcgctccgcggctgcaccggccccatgagcccgcggctccccgtcgcccgggccgtccgtagcccctgacctgacctgtcctcgccatggccgaggccgcctccggcgccgggggcacgtccctggagggcgagcgtggcaagaggcccccgccggagggcgagcctgcagccccggcgtccggagttctggataagcttttcggaaagcggctcctgcaggctggtcgctacctggtgtcccacaaggcgtggatgaagacggtgcctacagagaactgcgacgtgctgatgaccttcccagacacgaccgatgaccacacgctgctatggctgctgaaccacatccgcgtgggcattcccgagctcatcgtgcaagtccgccaccaccgccacacgcgtgcctacgccttctttgtcaccgccacgtatgagagcctactccgaggggccgacgagctgggtctgcgcaaagcagtgaaggccgagtttggcgggggcacccgcggcttctcctgcgaggaggactttatctatgagaatgtggagagcgagctacgcttcttcacctcccaggaacgccagagcatcatccgcttctggctgcagaatttgcgtgccaagcagggagaagcactccacaacgtgcgcttcctggaggaccagccaatcatcccggagctggcagcacgtgggatcatccagcaggtgttccctgtccacgagcagcgtattctgaaccgcctcatgaagtcatgggtgcaggccgtgtgtgaaaaccagcctctagatgacatctgtgattactttggtgtgaaaattgccatgtacttcgcctggctgggcttctacacgtcggctatggtatacccagctgtcttcgggtctgtcctgtacacattcacagaggctgatcagacaagccgggatgtttcctgcgtggtctttgccctcttcaacgtgatctggtcgacgctgttcctagaggaatggaagcggagaggggctgagctggcatataagtgggggacgctggactcacctggggaagccgtggaggagccacgcccccagttcaggggcgtgcgacgtatcagccccatcacgcgggccgaggagttctactacccgccctggaagcggctgctcttccagctgcttgtgagcctccccctgtgcctggcgtgcctcgtctgtgtcttcttgctcatgcttggctgcttccagctgcaggagctggtgctgagcgtgaaggggttgccccgtctcgcccgattcctgcctaaggtcatgctggccctgcttgtcagtgtgagtgccgagggctacaagaagctagccatctggctcaatgacatggaaaattaccggctggagagcgcctatgagaagcacctcatcatcaaagttgtcctgttccagtttgtcaactcgtacctgagcctcttctacatcggtttctacctcaaggacatggagcgcttgaaagagctcctgctcgtcctgtccctgtcccagagcctcgagcggcagctgcaggcggtgctggtcccgctcgcggccctgcggttccgcctgctcctcctctccctccggggcctcctgctcgcggcccgggccaaagtacgggcaggtggcgagcccgtgggtcctcgccggggtgggcagcgtggctgtgctgggggcctggcgcgccgagctgagggcgcatgcgcggagggaatctggggtcgggggcggccagcaagcaggtgcaggcggctgggggcgcacgcggcccagtgcaccgacagagcccgcggtggggtggagacgcgctgggcctgcccgtga

SEQ ID NO: 107953 - DNA, 2542 bp, Homo sapiens
  Payload ID: 1192
  Gene Symbol: ANO9
  Gene Name: anoctamin 9
  Uniprot ID: A1A5B4
  ENST ID: ENST00000332826
  CDS Start-End: 86-2434
acgcggaagtcaggtaggagcacccgccgctggcagccactctcctggccgccaaaccccagctggaactccggccacagccagcatgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactctcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcatcatcatgaccaagatcaacaggtgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtagggccagagcccgtccagaggccaccaggagctgagacagtgccaccaccagcacctcccacaagcccaccgctgtgcgtgttgaggggtgctgtgagaaggctgtgcc

SEQ ID NO: 107954 - DNA, 1765 bp, Homo sapiens
  Payload ID: 1193
  Gene Symbol: ANHX
  Gene Name: anomalous homeobox
  Uniprot ID: E9PGG2
  ENST ID: ENST00000419717
  CDS Start-End: 53-1192
gtgcgccggcgctgaagcgggtcccggaggagtggccacgacccagcacaggatgcagagcttcctgactctgctgaaggagcatgaggacacctgtgcacccccggcggagctggtgacccttgcgggcagactgtgccgggacttccaggatgaccttgcccaactgcagcctttggtcacagccattctggacagccagctccgcctgcatctcctggacaacgcagatgtggccctggcgtgcgcccgtgtcctggaccagcaggagcagcagcaggcggcttgccgcctcctggaggggtgccaggtgccgggaggcagccaggagttagtgcagctctggaacgacatccactaccgtctggtcatgaggaggctgggcgtggctgcgctcaccccggtgcagaagttccgctgcaggaagaggaaccccccgcccccctccctctgcccagaggggctgaagagccggaacttccccagagaggttcgtgagaagctgcacaatttcgctgtgggggtgaacaccaaccccagcaaggctgagagggagaacttggcattggagacgagcttgacccctgagcaggtgtacaactggtttgccaattaccggcgccgccaaagagcccttccccagcacatgaagccagcccagcaggccacagctgaagaccctggtgcgagggagaggggtcctgacctcctgcagccctcaggcaacccccgtgttgactctgggtttgtggacaggcctcagtggtcagaggaacgtgaggaaaaggggcctccacagtccccacagaccacccaaggaccatgggagccactggccttagccccggactttcccgcagatgagacagtctcaaagccactggatgtcagcggccatccccagagcgtgcaattggaggagggtctgggcacaagcagtggacggacagagctacgggtgggcagcttcctggtgacacagcccccactgcaagctcctgaattcatcctcacccagagccctccagagctggccccagccccatctgccttccccggccctgtgtctgccatggagctgagccaggccctgccctccagccaggtgcagtgttctgatagccaggcctctggtgatgccttctggggagccaggatgctccttgagttttcagggagcagcctgggctgagctatccccaggagccagacagcaccccaggaggagcgggtgtggatggtctgcctggtcaacacaaggagttacagagctttatcctgaatacaaaatgaaggtccccagagttcccctgggggctctgctgaaaagcagagattctttcccactgccatgtttgaatagtttggttagcaattccctgtagtagagaaagcatttgagaaatgttcgtgagatcagaagtcaaaggtgggtctgtcccactcacgcagcactggatcagtcgggctccggggcactcgtgcagagaaggccattctagagaggggagtgttctgctgctggctgccttgccgtctgcccgtgcacacagccagacttttccaccaagttaactgagtgaggtatgaggagtgttctgagatttctgtgtgtaggggcttctcccttgagtactgggaggcaaacctgtctgcgaatggcctaggcagggcagagtagggtggattttccctccaggttgtaattcactgtgtctatgacacaaatgttgtagtcaattaaagtttaatgttttgaactccc

SEQ ID NO: 107955 - DNA, 3452 bp, Homo sapiens
  Payload ID: 1193
  Gene Symbol: ANHX
  Gene Name: anomalous homeobox
  Uniprot ID: E9PGG2
  ENST ID: ENST00000545940
  CDS Start-End: 1740-2879
accccgcaccgcacaccccagaaaccccaggtcgtccgggactcctcggacccgcagatgccacggacaccagatcccccacggacccctcagctcccccggactccgcggtcgcatcgggggctgaggggcgccggcccccgggacgccttgtgggcggggcctcgcgggattggctgcgagcctggatactttgtagcacccgcaccttctgtgctgcccagcgcctcctcgccagccccgggtgcgcgccaagcacgtgcgccggcgctgaagcgggtcccggagggtgaggggcgcgcgggcaggggggtccgggaggatgagggacgcgcgggggcagggggggcctggaatgtgaggggcgcgggggcgggggtcccagagggtgaggggcgcgcaggcggggggggtcctggaggataaggggcgcggaggcggggggtcccggaaggtgaggggcgctagggcaggagtccctgagggtaaggggggccccggagggtgaggggtgcgggggccggggtggggctgagggtggagcctcccaggctggagccccaggcaggaatttcggcctccgcagggagcagcgtgccagaaaggtaggggggctgggggccatgggcgggggtcccgccaaagtcaggaagccaagcagagccacctcccgcgacccttcccctccattcagctggagccgggtgcccctcagggcaccgggcggacaggccaaggtaccccacaggaacctttttccttcctgaagtggcaggaaccccgcccctcccagagccggtgggggtcggcgttgcaggaaacccaggcctgggagcctcctctgccctcctccaaggcccctgcaggctctgttcccccaagggaccccaggtccagggcctcctgcccactgtggcagctggaaactcagagccccgagtcaggacccgggtgagatggcgctagagcccgggaacgggtggagtagacgaggtcgcgtccccttggcgggcgcacggcagaaagaacccctcgccagggagcgcgcagcctacctggttcttcgcggctgtgaggatttacaaaccttttggaaagcagtttggcaacacctactaccctgcccctacttctgtgaataaaagtgtattccgcagaagtaagatcgattggggagggttttctgttgggaaaagcagtcactggcagctgcctgaatgtccttaggtgaggcaccgttagaacaagtaaaggttcctcctgtgtggatgcaggaccaagcgtgtgattgcaaagtgtgtctttgacattgtttggattaagtattggcgtgagcagtttctgctgttaaaacaagtgcatgtatgtgggttcagatgaaaggccttggcatccactggtgacccctgcacacaaggtccctaccctactgagcccagagcagtggaggagctgttgcagacagtacccagcccagtgcttggtgcacagccgtgttcgttaaggactaaagtatttgggggattagaaggaaattctagagggtgtatgctatggtgctgccctctctcgggatgtgtgaggtcttattcctactctacaagtgtccacggcacaagagccgtgcatcacctgctttgcagagtgggttgggcgattgactgacagaaaggacgtggtcagtggtggccattcttgtgactgtttgtgttggcagagtggccacgacccagcacaggatgcagagcttcctgactctgctgaaggagcatgaggacacctgtgcacccccggcggagctggtgacccttgcgggcagactgtgccgggacttccaggatgaccttgcccaactgcagcctttggtcacagccattctggacagccagctccgcctgcatctcctggacaacgcagatgtggccctggcgtgcgcccgtgtcctggaccagcaggagcagcagcaggcggcttgccgcctcctggaggggtgccaggtgccgggaggcagccaggagttagtgcagctctggaacgacatccactaccgtctggtcatgaggaggctgggcgtggctgcgctcaccccggtgcagaagttccgctgcaggaagaggaaccccccgcccccctccctctgcccagaggggctgaagagccggaacttccccagagaggttcgtgagaagctgcacaatttcgctgtgggggtgaacaccaaccccagcaaggctgagagggagaacttggcattggagacgagcttgacccctgagcaggtgtacaactggtttgccaattaccggcgccgccaaagagcccttccccagcacatgaagccagcccagcaggccacagctgaagaccctggtgcgagggagaggggtcctgacctcctgcagccctcaggcaacccccgtgttgactctgggtttgtggacaggcctcagtggtcagaggaacgtgaggaaaaggggcctccacagtccccacagaccacccaaggaccatgggagccactggccttagccccggactttcccgcagatgagacagtctcaaagccactggatgtcagcggccatccccagagcgtgcaattggaggagggtctgggcacaagcagtggacggacagagctacgggtgggcagcttcctggtgacacagcccccactgcaagctcctgaattcatcctcacccagagccctccagagctggccccagccccatctgccttccccggccctgtgtctgccatggagctgagccaggccctgccctccagccaggtgcagtgttctgatagccaggcctctggtgatgccttctggggagccaggatgctccttgagttttcagggagcagcctgggctgagctatccccaggagccagacagcaccccaggaggagcgggtgtggatggtctgcctggtcaacacaaggagttacagagctttatcctgaatacaaaatgaaggtccccagagttcccctgggggctctgctgaaaagcagagattctttcccactgccatgtttgaatagtttggttagcaattccctgtagtagagaaagcatttgagaaatgttcgtgagatcagaagtcaaaggtgggtctgtcccactcacgcagcactggatcagtcgggctccggggcactcgtgcagagaaggccattctagagaggggagtgttctgctgctggctgccttgccgtctgcccgtgcacacagccagacttttccaccaagttaactgagtgaggtatgaggagtgttctgagatttctgtgtgtaggggcttctcccttgagtactgggaggcaaacctgtctgcgaatggcctaggcagggcagagtagggtggattttccctccaggttgtaattcactgtgtctatgacacaaatgttgtagtcaattaaagtttaatgttttgaactccc

SEQ ID NO: 107956 - DNA, 6314 bp, Homo sapiens
  Payload ID: 1194
  Gene Symbol: ANOS1
  Gene Name: anosmin 1
  Uniprot ID: P23352
  ENST ID: ENST00000262648
  CDS Start-End: 151-2193
gtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctgttggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagatcctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagtgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcgtagctcaccaatggtgagtaaagatacagctcttttaaaggtcataaggataatatattttccccatcaatgctgattctgagaaaagagcaatttatcaaaattaaacactgtaaaagaaaggtgtccatatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcactgcagctcctgtcacaagctgggatggatttatcacattgagttatgaaattacctggttctaagaatttttgagtggcaaaaatagaaaacaatcttcatttgaaaacatccctaagcttgaataaatggataccatagatagcttctcttttttattctggtgtcattaccagcatctgaatttcaagttcttaaaatttcaaaaattaaaatttttcattattagctatccatttatcttttacatgaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgactgtatacagaggttcatctcaacctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccaga

SEQ ID NO: 107957 - DNA, 2191 bp, Homo sapiens
  Payload ID: 1194
  Gene Symbol: ANOS1
  Gene Name: anosmin 1
  ENST ID: ENST00000619786
  CDS Start-End: 152-2191
ggtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggcgcctggcggccggccccggcgcggctgtgcgcggcggctggacgagtcgctgtctgccgggagcgtccagcgcgctcgtgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctgttggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagatcctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaa

SEQ ID NO: 107958 - DNA, 2110 bp, Homo sapiens
  Payload ID: 1195
  Gene Symbol: AMN1
  Gene Name: antagonist of mitotic exit network 1 homolog
  Uniprot ID: Q8IY45
  ENST ID: ENST00000281471
  CDS Start-End: 167-943
ttctttccttgtggagtccgaagcgtggccacgccccggtcaccggaaaaatccgtgtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaa

SEQ ID NO: 107959 - DNA, 571 bp, Homo sapiens
  Payload ID: 1195
  Gene Symbol: AMN1
  Gene Name: antagonist of mitotic exit network 1 homolog
  ENST ID: ENST00000457428
  CDS Start-End: 277-571
agacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagggtcatgctccgttgcccaggctggagtacagtggtgcaatctcagctcactgcaacctccgctgcctggacttagagacagggtttcaccatgttgcccaggctggtctcgaactccggagctcaagtgatccatccgcctcagcctctcaaaatgctgggattacagattttacat

SEQ ID NO: 107960 - DNA, 796 bp, Homo sapiens
  Payload ID: 1195
  Gene Symbol: AMN1
  Gene Name: antagonist of mitotic exit network 1 homolog
  ENST ID: ENST00000535408
  CDS Start-End: 148-796
cgtgtgacgtcacaaaaacctacgcgtcgcgcggtgggcgggagttggcggacggtccctggctgggttctggaggccctgggaccgcggaagaggcttcagacgctgcagcgatgcctcgcccacggcggatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacag

SEQ ID NO: 107961 - DNA, 880 bp, Homo sapiens
  Payload ID: 1195
  Gene Symbol: AMN1
  Gene Name: antagonist of mitotic exit network 1 homolog
  ENST ID: ENST00000541931
  CDS Start-End: 570-746
acaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctc

SEQ ID NO: 107962 - DNA, 403 bp, Homo sapiens
  Payload ID: 1195
  Gene Symbol: AMN1
  Gene Name: antagonist of mitotic exit network 1 homolog
  ENST ID: ENST00000506446
  CDS Start-End: 87-403
atgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagggtcatgctccgttgcccaggctggagtacagtggtgcaatctcagctcactgcaacctccgctgcctggacttagtccaaactctagatctacggagctgcgatatatcagatgctgctctcctgcacctgtctaactgtagaaaactgaagaaattaaatttaaatgcttcaaaagggaaccgagtttctgtaacttc

SEQ ID NO: 107963 - DNA, 1025 bp, Homo sapiens
  Payload ID: 1195
  Gene Symbol: AMN1
  Gene Name: antagonist of mitotic exit network 1 homolog
  Uniprot ID: Q8IY45
  ENST ID: ENST00000536761
  CDS Start-End: 277-999
agacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgcta

SEQ ID NO: 107964 - DNA, 1538 bp, Homo sapiens
  Payload ID: 1195
  Gene Symbol: AMN1
  Gene Name: antagonist of mitotic exit network 1 homolog
  Uniprot ID: Q8IY45
  ENST ID: ENST00000537562
  CDS Start-End: 457-1179
cgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagattaaggccgagcacaaggctcatgcctgtaatcccagcagtttgggaggccaaggtgggaggctcacttcagcccaggagttcaagaccggcctgggcaacatatagagaccccatctctacaagaaatacagaaaattagctgattgtggtggtgcatgtctgtagtcccaactacttgggaggctgagatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttct

SEQ ID NO: 107965 - DNA, 397 bp, Homo sapiens
  Payload ID: 1195
  Gene Symbol: AMN1
  Gene Name: antagonist of mitotic exit network 1 homolog
  ENST ID: ENST00000537960
  CDS Start-End: 136-397
acgctgcagcgatgcctcgcccacggcgggtcagtcagctcctggatctatgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaag

SEQ ID NO: 107966 - DNA, 879 bp, Homo sapiens
  Payload ID: 1195
  Gene Symbol: AMN1
  Gene Name: antagonist of mitotic exit network 1 homolog
  ENST ID: ENST00000542781
  CDS Start-End: 690-797
agacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagggtaacactggcctcacagaaagagttggaaagtgtttcccccttcttctatagccacccagctttgtcatggttgccatttaaatg

SEQ ID NO: 107967 - DNA, 782 bp, Homo sapiens
  Payload ID: 1196
  Gene Symbol: AGR2
  Gene Name: anterior gradient 2, protein disulphide isomerase family member
  ENST ID: ENST00000401412
  CDS Start-End: 43-609
ggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgaggtgagagagagctaggcttagggacgcctcggactcagtttgaccctaactagccttgcatcttcaggcaaatcacactctttccatctcaggtttgtttgtttttaatctcaattgaagatgaattatttagattaggtatctttttctctaggaggattctatgaccacattacc

SEQ ID NO: 107968 - DNA, 1778 bp, Homo sapiens
  Payload ID: 1196
  Gene Symbol: AGR2
  Gene Name: anterior gradient 2, protein disulphide isomerase family member
  Uniprot ID: O95994
  ENST ID: ENST00000419304
  CDS Start-End: 154-681
tagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacaga

SEQ ID NO: 107969 - DNA, 670 bp, Homo sapiens
  Payload ID: 1196
  Gene Symbol: AGR2
  Gene Name: anterior gradient 2, protein disulphide isomerase family member
  ENST ID: ENST00000412973
  CDS Start-End: 277-670
agattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttg

SEQ ID NO: 107970 - DNA, 671 bp, Homo sapiens
  Payload ID: 1196
  Gene Symbol: AGR2
  Gene Name: anterior gradient 2, protein disulphide isomerase family member
  ENST ID: ENST00000450569
  CDS Start-End: 1-360
cccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaa

SEQ ID NO: 107971 - DNA, 749 bp, Homo sapiens
  Payload ID: 1197
  Gene Symbol: AGR3
  Gene Name: anterior gradient 3, protein disulphide isomerase family member
  Uniprot ID: Q8TD06
  ENST ID: ENST00000310398
  CDS Start-End: 72-572
aaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatggaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgagactgac

SEQ ID NO: 107972 - DNA, 563 bp, Homo sapiens
  Payload ID: 1197
  Gene Symbol: AGR3
  Gene Name: anterior gradient 3, protein disulphide isomerase family member
  ENST ID: ENST00000402239
  CDS Start-End: 66-557
ccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctatgtaagtattcacaaatgatctcaaacagtggtcatagctgacccctg

SEQ ID NO: 107973 - DNA, 386 bp, Homo sapiens
  Payload ID: 1197
  Gene Symbol: AGR3
  Gene Name: anterior gradient 3, protein disulphide isomerase family member
  ENST ID: ENST00000414935
  CDS Start-End: 1-386
aaacatccagaatacatttccaacaagagcactggccaagtcaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctat

SEQ ID NO: 107974 - DNA, 5859 bp, Homo sapiens
  Payload ID: 1198
  Gene Symbol: ANTXR1
  Gene Name: anthrax toxin receptor 1
  Uniprot ID: Q9H6X2
  ENST ID: ENST00000303714
  CDS Start-End: 323-2017
gacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaactcttttttctggttgtctgtttgttataaagtgcaacgtattcaagtcctcaatatcctgatcataataccatgctataggagactgggcaaaacctgtacaatgacaaccctggaagttgcttttttaaaaaaaataataaatttcttaaatcaa

SEQ ID NO: 107975 - DNA, 1384 bp, Homo sapiens
  Payload ID: 1198
  Gene Symbol: ANTXR1
  Gene Name: anthrax toxin receptor 1
  Uniprot ID: Q9H6X2
  ENST ID: ENST00000409349
  CDS Start-End: 104-1210
aggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaaaataaaataaaataacaagaagaagaaagaaagaaatcccacagaaacagataacctaacacagcccgtgcaacgtattttatacaatgctctgaaaatcatagtctcaatctagacagtcttttcctctagttccctgtattcaaatcccagtgtctaacattcaataaatagctatatgaaatcaaa

SEQ ID NO: 107976 - DNA, 2221 bp, Homo sapiens
  Payload ID: 1198
  Gene Symbol: ANTXR1
  Gene Name: anthrax toxin receptor 1
  Uniprot ID: Q9H6X2
  ENST ID: ENST00000409829
  CDS Start-End: 195-1196
gaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtagcctccacaaaattgcatcaggccccacaacagctgcttgcatggaatagcagagaataccgcctgctccctccggacagcacactcctgaaaacggggagagaggagccaaacatgctcggtttacactttccttatttactgaatgagtggagggcagagacaggcctggagttacgcacactgagtgccccaacatggaaagaaacatcaggagggacaggaaacgttccctccttaaccaacagttttcaagaccttactggaggcactttattggctacataatcactccatgcggtgggcatcaggcagaatcctggtgcagacccaactttgaggtggaggatttcacagtttctttattttgaacttcccccaggctcccactaattcctctccattctatcctcctccctttcccacaaaagaaaacagaaaggagcagcagtgtttgataccgtatcatccagaggcctggttctctcccattatagggcaaacaagccctggcaagatatttcactcccgccccatgccatgcattaaaaatccaaaattgcctatattccacctgccaagcaagagatgctttcattattgaagttccaaatgtatacctttgagaacagtgccttctcgtcttaaaagagaggtcctcattttgtgagttgggagcagagggaattaaagaaagccatgatgcagggatttggccattcaagccgggcagccttcagagaatgtcatccctaatgacacatgcccgaatgaaggagcggggctgagcttgtcctgccttcgtattgaatgttgcctgtctgcctccttaatagcgggcctctgtgtgagcatttgacaagacttaaaactattcattgaagaaaatggatgatcccccaacaggaagatgcaaccccatgggctgcctgcttgaccacagaagtgcttccagctccagttgctcatctgagaactccccccaccacttgctgttaaaattgttaaaattaaaggccatgttgattgattttttaaactttatttccattttttttaataaaataagaattgg

SEQ ID NO: 107977 - DNA, 621 bp, Homo sapiens
  Payload ID: 1198
  Gene Symbol: ANTXR1
  Gene Name: anthrax toxin receptor 1
  ENST ID: ENST00000482235
  CDS Start-End: 1-539
gagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgtgatggcttgtggttttacatacaatcattagagacggtaaaagaccacaggaatatcagagtgcggaactcagatctcaaatattgtttatgaactgaaataaaagtagtttgccaacatctctattttgacaacccttgtaacccttatatgtataaaaatatcttttaaaaga

SEQ ID NO: 107978 - DNA, 1473 bp, Homo sapiens
  Payload ID: 1199
  Gene Symbol: ANTXR2
  Gene Name: anthrax toxin receptor 2
  Uniprot ID: P58335
  ENST ID: ENST00000307333
  CDS Start-End: 4-1473
aggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttga

SEQ ID NO: 107979 - DNA, 1343 bp, Homo sapiens
  Payload ID: 1199
  Gene Symbol: ANTXR2
  Gene Name: anthrax toxin receptor 2
  Uniprot ID: P58335
  ENST ID: ENST00000346652
  CDS Start-End: 141-1301
cgctgccgcaggcgccggcgtctcagctgctcgccgccccccaccccagagtgcgtgccgggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattcttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttgagtcagtataatggaggcagggaaatagtaataaaaaatgatt

SEQ ID NO: 107980 - DNA, 1469 bp, Homo sapiens
  Payload ID: 1199
  Gene Symbol: ANTXR2
  Gene Name: anthrax toxin receptor 2
  ENST ID: ENST00000404191
  CDS Start-End: 158-1393
agtcttgggtttgtgaaccacgcatgggggctgttttagcacagctgctaaaataggccaggcctgcaggacatacgggtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaa

SEQ ID NO: 107981 - DNA, 8273 bp, Homo sapiens
  Payload ID: 1199
  Gene Symbol: ANTXR2
  Gene Name: anthrax toxin receptor 2
  Uniprot ID: P58335
  ENST ID: ENST00000403729
  CDS Start-End: 527-1993
tttcggagtgcggagggagttggggccgccggaggagaagagtctccactcctagtttgttctgccgtcgccgcgtcccagggaccccttgtcccgaagcgcacggcagcgggggggacttcagccctccaggcggggtgggttccaggtccgggtccgaggcgggcgctggaggctcggccccaggccggagaggaactcctttcgcgagctgtcgccgtgggcccgcattgtctgcaggaactctccggaatcgggagggggaggactggatcgcgcttccactgggattcgtcaagagttccggcggcagctgcggcggtggcggagactccctttgtcctctcaggacctccctctctccctccctgtcagctggtgggtcccgctgccgcaggcgccggcgtctcagctgctcgccgccccccaccccagagtgcgtgccgggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcattttttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcagggatggaattctattcagttccaaaatgtccctcatgttcacagatgatactattggcagtagctgcatatgcaagtgtaacttggaagcctgatatagtatacccaaccctttctgcaatgagttattgtatccctttgttctgcatttgcatctggaacaagacctaatgtggcttccttaaatgggcacttcatttctgatgagtgcacaccaattattgctattttaatatcattgagaatactacagaagctaaggctatgtttctttggtaactacttcaaatttctctagaattatgtagcatacttacattttgctgcatgaacaatgaaaattaacctctgcctttaaatggaaaaataactttctgtagattgttatacagctactatgaagagctcttaatgaagaggaagtggcagtggtctatatgtagactgaaaaaatatcattaataaagttcaaagactgatggaatttcattgcccttaaagatatgaaccagatctgttttatgcttttctccaattatactaactagcagttgaaaagaatttgttttgaagagtgttattttcttaccaaaagaccagatcaaaaatccctatacttttccaccaaaaaaagattaaaatgaagccatttctataaatttaatggcactttatattttatatagagaaatagcttctgtttgattttctggacaccatgtcagtcaagatctactttctgtgtaaaaatgaataagtcttgcacataatccattcgtgttgcataaggttgcaaaaacaattaagtgggaaatgactcctaacttatgtgtctactctgcctagaaagaaagttttgaaggcatctatatatatttcataacaatgtctgttctttatggatttgatccataaatatttatctatctgaaaactttgatacttggaatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttataataaatccttactagatacaagatttgggtgtttctgtgaagttaactttattatctaaatatcactaaccattgtttactgctcagaggcagatacatttgtttagtttaaagttgaaacaaattctatattgtggataattaggtgtttaaaacattttgatagaccagcttatatatgttatttttgaaatttaagaaggcagaatgtaattaggtcacatttacaagtagaaggaattataacttcctactccatgcatatattgtatattggttagcttttactagcattttctagcatcacattactttagaaagtttttgagagtttcattactactggaaaagtttggtgggtatatgtacacaggaaagaaatatatgcatcatttcaatatgaaaggaaatacataatctagaaacatagaataactcttggtacatctgttacatagttaaggaaagaaacaggcaggtgaggctggagaatgttgtctatttgtaggaaataaagtcagtgcagacgcatattctagtttagagttagattaatattgtgcttagtgaatttctatgacatatttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgtgagagagagagagagagagagaaacagagggagaattgactcaatgtgttttctatgaagagtcttagcttaggaatcaggtaacagagaggtcctagaccatagacccagccatcaactagcttgctgatgttgaacagatcaactctcaaccatagactgaagatggaatgaagatatcaaaagttccttttagcactgactagattttttttcttttttttgaaacagagtctcactctgtcacccaggctggagttcaatggcatggtctgggctgactgtaacctcctcttcctgggttcaagtgattctcatccctcagcctcctgagtagctgggattacaggcacataacaccacacccagctaactcttgtatttttgtagaaatggggtttcgctatgttgctcagactggtctcaaacacctggcctcaagtgatcctcctgcctcagtctcccaaatgctgtgattacaggcacaagctactgcaccaggcctctgactacatttctattaatatggttaggttggaggttttagtatttttgtatctcatatttgtatcaatatgactggcttctttgtctgtagtgtgtggtaatattagttctgtaaactgtcagttgcaaaaaaaaaaaataccttgaactatagtatatgttgataattagccataataatttcttagttaatttcttataattaaatttgtcaaagaggaaacttacagtttatatctgatgaaatctctaaaaagatgggtaaaacattgggaaatgtatgcatgtacttcactctggtttcatagggttagcaagtgtcttaaaaacatatataaagaagcacagagattgttaggagatatttatgctcccagttttaataattgggatactttgtataccacagaaagaaaaattactaaactcctctttttttagtcaaaattggaaaaaaagtcttaattgacagttactatgcctgtgctacccatagcaagtattcagtggaaaatactttactaagtaagtaatttgaacacagcttaaaatccatagtatgttacaattgctagcctttcacaaagtttgcattgtcttaatgtagaaggatactgtgatctaagaattcacaattttaaaaagtggaacctaaatagggtttcctaattgccatgaagttatttgtatcttagatgaattatatttacaacattgtaaatgtcagtgggtgatccaaaataaattgttaaagttattaaaatgtacatttaagtaggtttcagtttgactagaaataattggcaagaaggcaagaactagtcttctagagcagggatcccatcccccaggtcatggactggtactggtccatggcctgttagaaaccaggccacacagcaggagatgagtggaaagcaagtgaaacttcatgggtatttacagcaattccccgtcgctcgcattaccacctgagctgtgtctcctgtgagatcagcagcagcattagattctcaaggagcacaaacccttttggaactgtgtgtgagggatctaagttgcgcatttcttatgagaatctaatacctgatgatctgttgttgtctcccaccacccccagatgggaccatctagttgcaggaaaacaagctcaggctcccactgattctacattatagtgagttgtgtaattatttcattatatataacaatgtaataataatagaaataaagtacataataaatgtaatccacttgaattatcctgaaaccatccccaccccccaccccccggtctgtggaaaaattggcttccacgaaactggtccgtggtgccaaaaatattgggtatggttgttctagggtgtagactatgaaaaagatatgcattgtctccatgaactaaaaggcaaggtgattttaaacaatttagatgccaaacaaagaaaccaaaagcttccaaagtaataaatgatagagaaaggaaattgttacatcatgtgccaaattagaagcaaatctaaacttcttatcatgtactccaccatctgatttgtataagtaattggggaaagaaaaactcacaatataaaacaagattgactagttctagcagatgacacctgtaaatagaatttttactagttgaaattctgatgtgaaatgaagccattattattatcacaataaagtgttctttttagttctttttttaata

SEQ ID NO: 107982 - DNA, 2026 bp, Homo sapiens
  Payload ID: 1199
  Gene Symbol: ANTXR2
  Gene Name: anthrax toxin receptor 2
  ENST ID: ENST00000449651
  CDS Start-End: 46-783
tataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagagtggggtctcactgtcacccaggctggagtgaagtggcatgatctgactcactgtacttttggcctttctggctcaggtgatcctcctacttcagcctcctgagtagctggggctacagaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatg

SEQ ID NO: 107983 - DNA, 430 bp, Homo sapiens
  Payload ID: 1200
  Gene Symbol: ANTXRL
  Gene Name: anthrax toxin receptor-like
  ENST ID: ENST00000614267
  CDS Start-End: 1-338
aggctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgggagtactctattgaagtcagcttgaacaaaggcaaaacattcttcaagagcaatgtcagcatcaccagcaccacatgtactgtcaaggagccaccacctgtgcagaagccagaaaag

SEQ ID NO: 107984 - DNA, 1964 bp, Homo sapiens
  Payload ID: 1200
  Gene Symbol: ANTXRL
  Gene Name: anthrax toxin receptor-like
  ENST ID: ENST00000622632
  CDS Start-End: 267-1964
cataacagagaattctgtccccagggtgggggaagggccaggcaggtagctggaagcaagtctcccagagccagctgctgaccctagtccctgcgatctggggaggtacctggtggagggccatagtgtgcactggtgaaagggcaggaggaggggtgtggccccgggcataaggggaggcggcaaagaaggggcctgtgctcagcctctctgggccctggcacaggcacccaagagtgaggtggggtcacagggacagccagataatggggagccatgagtccctggggccctacttcctggtcttcctgctgctgctgctgcttcctccaccgctttttagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtggcattttccgcaactggctctattttgtgccactcctgctgcttgtgccactgctgctgtgttgtgtctggcggctgtgccgcaagcagactgtcaaggagccaccacctgtgcagaagccagaaaaggagccagagcaggaaaaaccaccatcaccaccaccaccgcctccgcctccaccacctccactcccgcctccgcccccagctcctgtaaacacctgccccactgtgattatttgttgctgtggatgccaaggagtgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagcccaaggatctgcctgagacacagcccggagtacttttcccaagcacagactctgtgcaacccaaagagctgccttcaacccagccgggagtgcctcgatgctgccgctgctgtccccactgctcaggcacacggcagaaccccctttgtcactccccccctcagagcccaacttctaaggcaccaaacacccaagattaa

SEQ ID NO: 107985 - DNA, 490 bp, Homo sapiens
  Payload ID: 1200
  Gene Symbol: ANTXRL
  Gene Name: anthrax toxin receptor-like
  ENST ID: ENST00000619553
  CDS Start-End: 308-490
gctgggaggaagcccaggtcacacggggaggctacatgcagggtctccattcacagtcccagctgagcccaggttttgggccctcctgcctaggagccacacttgaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggattt

SEQ ID NO: 107986 - DNA, 2206 bp, Homo sapiens
  Payload ID: 1200
  Gene Symbol: ANTXRL
  Gene Name: anthrax toxin receptor-like
  Uniprot ID: A6NF34
  ENST ID: ENST00000620264
  CDS Start-End: 266-2161
ataacagagaattctgtccccagggtgggggaagggccaggcaggtagctggaagcaagtctcccagagccagctgctgaccctagtccctgcgatctggggaggtacctggtggagggccatagtgtgcactggtgaaagggcaggaggaggggtgtggccccgggcataaggggaggcggcaaagaaggggcctgtgctcagcctctctgggccctggcacaggcacccaagagtgaggtggggtcacagggacagccagataatggggagccatgagtccctggggccctacttcctggtcttcctgctgctgctgctgcttcctccaccgctttttagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtggcattttccgcaactggctctattttgtgccactcctgctgcttgtgccactgctgctgtgttgtgtctggcggctgtgccgcaagcagactgtcaaggagccaccacctgtgcagaagccagaaaaggagccagagcaggaaaaaccaccatcaccaccaccaccgcctccgcctccaccacctccactcccgcctccgcccccagctcctgtaaacacctgccccactgtgattatttgttgctgtggatgccaaggagtgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggagtgcctcgccctcaaacaggctcgctgcagcccaaacatctgcctgagacacagccaacacagcagggagtgccttgcccgcaaacaggctccctgcagcccaaggatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgtccccactgctcaggcacacggcagaaccccctttgtcactccccccctcagagcccaacttctaaggcaccaaacacccaagattaacaggcttttgttgctgaactgga

SEQ ID NO: 107987 - DNA, 2125 bp, Homo sapiens
  Payload ID: 1200
  Gene Symbol: ANTXRL
  Gene Name: anthrax toxin receptor-like
  ENST ID: ENST00000617088
  CDS Start-End: 253-1026
ataacagagaattctgtccccagggtgggggaagggccaggcagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtccttctcttaagtagagctctggacatgaggaaggcctgagcagcctgccttcccacggatgccgcccaagattcctttattgcgaagaacacccagagaactgttcccgttgcttataccccatgtggccctggttctgagccaggacttggagctctctaaacctcacaagtgcccccagggagggcggctcattccctttgcacagggcattttccgcaactggctctattttgtgccactcctgctgcttgtgccactgctgctgtgttgtgtctggcggctgtgccgcaagcagactgtcaaggagccaccacctgtgcagaagccagaaaaggagccagagcaggaaaaaccaccatcaccaccaccaccgcctccgcctccaccacctccactcccgcctccgcccccagctcctgtaaacacctgccccactgtgattatttgttgctgtggatgccaaggagtgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggatgccttgcccgcaaacaggctccctgcagcccaaggatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgtccccactgctcaggcacacggcagaaccccctttgtcactccccccctcagagcccaacttctaaggcaccaaacacccaagattaacaggcttttgttgctgaactggacatatacattgagtcttttcttgcggtcaaaggagttgaattcttgctgatcaactaaagttgattgtgtttgacacc

SEQ ID NO: 107988 - DNA, 3963 bp, Homo sapiens
  Payload ID: 1201
  Gene Symbol: MFI2
  Gene Name: antigen p97 (melanoma associated) identified by monoclonal antibodies 133.2 and 96.5
  Uniprot ID: P08582
  ENST ID: ENST00000296350
  CDS Start-End: 115-2331
cacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgggaagacgcttccctcctggggccaggccctgctgtcacaggacttcgagctgctgtgccgggatggtagccgggccgatgtcaccgagtggaggcagtgccatctggcccgggtgcctgctcacgccgtggtggtccgggccgacacagatgggggcctcatcttccggctgctcaacgaaggccagcgtctgttcagccacgagggcagcagcttccagatgttcagctctgaggcctatggccagaaggatctactcttcaaagactctacctcggagcttgtgcccatcgccacacagacctatgaggcgtggctgggccatgagtacctgcacgccatgaagggtctgctctgtgaccccaaccggctgcccccctacctgcgctggtgtgtgctctccactcccgagatccagaagtgtggagacatggccgtggccttccgccggcagcggctcaagccagagatccagtgcgtgtcagccaagtccccccaacactgcatggagcggatccaggctgagcaggtcgacgctgtgaccctgagtggcgaggacatttacacggcggggaagacgtacggcctggttcccgcagccggggagcactatgccccggaagacagcagcaactcgtactacgtggtggccgtggtgagacgggacagctcccacgccttcaccttggatgagcttcggggcaagcgctcctgccacgccggtttcggcagccctgcaggctgggatgtccccgtgggtgcccttattcagagaggcttcatccggcccaaggactgtgacgtcctcacagcagtgagcgagttcttcaatgccagctgcgtgcccgtgaacaaccccaagaactacccctcctcgctgtgtgcactgtgcgtgggggacgagcagggccgcaacaagtgtgtgggcaacagccaggagcggtattacggctaccgcggcgccttcaggtgcctggtggagaatgcgggtgacgttgccttcgtcaggcacacaaccgtctttgacaacacaaacggccacaattccgagccctgggctgctgagctcaggtcagaggactatgaactgctgtgccccaacggggcccgagccgaggtgtcccagtttgcagcctgcaacctggcacagataccaccccacgccgtgatggtccggcccgacaccaacatcttcaccgtgtatggactgctggacaaggcccaggacctgtttggagacgaccacaataagaacgggttcaaaatgttcgactcctccaactatcatggccaagacctgcttttcaaggatgccaccgtccgggcggtgcctgtcggagagaaaaccacctaccgcggctggctggggctggactacgtggcggcgctggaagggatgtcgtctcagcagtgctcgggcgcagcggccccggcgcccggggcgcccctgctcccgctgctgctgcccgccctcgccgcccgcctgctcccgcccgccctctgagcccggccgccccgccccagagctccgatgcccgcccggggagtttccgcggcggcttcgcgctggaatccagaaggaagctcgcgaaggccgggcccggcgtgggcgggagcaggcgcctccccgggagccccgccgcccacgggcgccacctggcgctgctacctgaggcgccgcccccgggcccgcgcggcccttcccgccaaccgccgcctcccgccacctggagccgcgcgggccgcgccggaggaggccggttgcccaggaaaccgctgagtccgggcttcccgccgcccgccccgcggtgtcgcccgaggggcccgcccgcctcctccccgcagccccgcgcccccgtccgcgaggccccctggggacgcggtggccgccgaggcgcctacacccgcaggccgcggccaggccgtcccaggaggccccggcgccaacgggacccggcgcgtgggacagcggcctctgctggcggcggcgggagggaggccggaccggggcgacggggagaagccttcgcccgcgggaccgtgtccggggtgggggctccagttcctccgaccgcccgtgcgctgggagggaggccgagcccggggaacgccgcgtgccctgcctcgtcccccactgtggccgcgccagctccatcccgggccagccgcgtccacgggccccctcccgagtctcctcaggctctcgcctcccctacccccgtgggatgcccaccgcccgcacccacgcccgagcctggcggcagcagccgccccccgcctgaagggagccggaggtgacccaggccgcgggctcccgaggcccctgaagggctgcgcgtggggacccgccatgcttctgggttccgaacgggggtgagctccgtctcctcacccggccccgcacccgctgggcctggggacccctcactccccgtgcccgcccctccgcgaggcagcagaaagcgcccggccggggcctctctctactccatcttgccacagttgtctgagaagccagaaaaagtttccagaactggcagcccttaaaaaaaatgaagaggaagagaagaaatgggagcaggcagccctcgtcagcagaccgggagccgcgtgggcgcggagccatttgcattccggtctgcgggggctcggggatgctggtgacaggcccggttcccggtggctcgcccccacctgcgggcgtcgggaaggatcccttccatctctcagccgcagaggaggccctggcagcgccccggctgtagccatgcaaccccgaggagtcccgggcaccttcaccccaccgggaggggccacaaggacctgggcctcggccaccaagctttgtcccctctcgctgtggggggctagtgattctcctccgacctgacgattgcttggttttttcaaaagggagttttgtgcggtgagaagtgtgtttctgtgtggctaactctgggctagcgtgccgtggccattgaaggtgtggcctgcgtgggtgcagtgtaagtgacgctggattgtcaggtggcagcaggggacccctgctgtgtcagtgctaatgaaacatgttggttggtttctaaaataaagccaaacaagccagcacatgcagaggcttggaccctgatagaaa

SEQ ID NO: 107989 - DNA, 1650 bp, Homo sapiens
  Payload ID: 1201
  Gene Symbol: MFI2
  Gene Name: antigen p97 (melanoma associated) identified by monoclonal antibodies 133.2 and 96.5
  Uniprot ID: P08582
  ENST ID: ENST00000296351
  CDS Start-End: 90-998
agggggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgaaagtccatcacgaaggcaaacatggaccagatctgaggaggaagaaggcgagtgccctgcacacgaggaagcacgtaggacgatgcgctctagtgctgggcaagcctggaaatgggctcccgttcacaggccccaggacgagtctgacaaaggagaatttggaaaacgggcaaagagtagggatatgttgggttaagaatcagctctttcaaacttggggttttttttgagatgggggtctcaccatgttgcccaggctggtctcaaacccccagcctcaactgatcctcgcatctcagcctcctgagtagctgggatgacaggcgtgcacctggcagctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcattaacagtgctgtaaactaccatgtggccattaacaatgacctttagggagttttcctaaacgatcactctggtgcgggtgtttggttttgttttaaaatagctttgcagtgaaagctttcatgaccatacaaattatcttttttcttcctatttccttgtagaggtttttttcctccttgtcttaaggtcataaaaatattgttatgtggga

SEQ ID NO: 107990 - DNA, 629 bp, Homo sapiens
  Payload ID: 1201
  Gene Symbol: MFI2
  Gene Name: antigen p97 (melanoma associated) identified by monoclonal antibodies 133.2 and 96.5
  ENST ID: ENST00000439320
  CDS Start-End: 86-629
ggagcagggaggaagcccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaaggacccaaacgaggtgccgacttgcacccagaaagctcccaagtggctcatcagccca

SEQ ID NO: 107991 - DNA, 1821 bp, Homo sapiens
  Payload ID: 1202
  Gene Symbol: AMH
  Gene Name: anti-Mullerian hormone
  Uniprot ID: P03971
  ENST ID: ENST00000221496
  CDS Start-End: 23-1705
ccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 107992 - DNA, 1863 bp, Homo sapiens
  Payload ID: 1203
  Gene Symbol: AMHR2
  Gene Name: anti-Mullerian hormone receptor, type II
  Uniprot ID: Q16671
  ENST ID: ENST00000257863
  CDS Start-End: 81-1802
gtatctgaagaaagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgacagcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgt

SEQ ID NO: 107993 - DNA, 1437 bp, Homo sapiens
  Payload ID: 1203
  Gene Symbol: AMHR2
  Gene Name: anti-Mullerian hormone receptor, type II
  Uniprot ID: Q16671
  ENST ID: ENST00000379791
  CDS Start-End: 1-1437
atgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaa

SEQ ID NO: 107994 - DNA, 1787 bp, Homo sapiens
  Payload ID: 1203
  Gene Symbol: AMHR2
  Gene Name: anti-Mullerian hormone receptor, type II
  Uniprot ID: Q16671
  ENST ID: ENST00000550311
  CDS Start-End: 70-1506
aagatttggccaggggcagctgtgctggcttatgctcttctccttctgctgctgccatcctccagcaagatgctagggtctttggggctttgggcattacttcccacagctgtggaagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtgagtccatctggatggcactggtgctgctggggctgttcctcctcctcctgctgctgctgggcagcatcatcttggccctgctacagcgaaagaactacagagtgcgaggtgagccagtgccagagccaaggccagactcaggcagggactggagtgtggagctgcaggagctgcctgagctgtgtttctcccaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgcagtccaccacccttccaactggcctatgaggcagaactgggcaatacccctacctctgatgagctatgggccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaa

SEQ ID NO: 107995 - DNA, 887 bp, Homo sapiens
  Payload ID: 1203
  Gene Symbol: AMHR2
  Gene Name: anti-Mullerian hormone receptor, type II
  ENST ID: ENST00000550839
  CDS Start-End: 371-887
caggtttgggtcagtgctctccagcctgcattcttgccttgatgtccagccctgctacagcgaaagaactacagagtgcgaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagctggcacccagaggtacatggcaccagagctcttggacaagactctggacctacaggattggggcatggccctccgacgagctgatatttactctttggctctgctcctgtgggagatactgagccgctgcccagatttgaggcctgacagcagtccaccacccttccaactggcctatgaggcagaactgggcaatacccctacctctgatgagctatgggccttggcagtgcaggagaggaggcgtccctacatcccatccacctggcgctgctttgccacag

SEQ ID NO: 107996 - DNA, 488 bp, Homo sapiens
  Payload ID: 1204
  Gene Symbol: ATOX1
  Gene Name: antioxidant 1 copper chaperone
  Uniprot ID: O00244
  ENST ID: ENST00000313115
  CDS Start-End: 99-305
gcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgg

SEQ ID NO: 107997 - DNA, 4341 bp, Homo sapiens
  Payload ID: 1204
  Gene Symbol: ATOX1
  Gene Name: antioxidant 1 copper chaperone
  ENST ID: ENST00000521264
  CDS Start-End: 111-332
agactaggagccggggatcccttcctgcctggcctccaacccactggggaacccaggcaatcctttctttccctggacccagatgctgcctctgagaatgcggcccttggatgaaagcagaatcacctgggaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggtgggtaaggccccagcacttgctgaacaaacctacagctcacacctctcatcagagcgaacaccttggcctttgagagcttgagtggagcgggagagccctctgggttcttttcaatccactgtccaccttctttggagtggttacaaatattttattattgtctaatgcaaatcacaagttcagggaattcttacagaccctgtgagtggacagagcactgtgtaatgtctcccagagtcctctttcagacttgagggttgcagttcatggttagcagggtttaagtttacagtatgtgaccctaagcagtgcacctttgacttctttatttgttcattggtttgagacagtgtttcactatatggcccaggctggagggtagtaactcttcataggtgtgatcatagtgcactatagcctttaactcctgggctcaagtgatgctcctgcctcagccttctaagtaactggaactataggcacctatcaccacacatggctctggctttgataaactgactatctcatcagagttgacacttgtgccttgggccttgttctcctgtgccctgaccaagtgagttaattcagactgtgccgctctctctacttgaaactgttgtcagcttcctgagcatgccctctgtccagactggtacaaaaacaatagcatgtttgagctagatgttcccttcacttttatgtaatccagtgatgcagtaaggggcactgtgccagcactcttcgctctggaaccaggcagaccttactcattgatccagccacagtctcagcagggcactcctggctgccactgcccatgtagtgcatttgactcgtgaattacaatgatcgccacacctctgatgtggtttggtgccctgacgtgactgagaaaaatgaggccaagagaggggaagtgattcaaccagagtcccaccctggtgagtagcagaggcaggaagaaagtcagatatcctgaatcggagttctgtaactgttactggtggcattgtccctgtgaatgggcccacagagaccccctggacagaggctagccacactgactggtaggtcctctttgaggatagcctccttcccaaaggcatacatttggaacctgagtcatagcagtgttctgtgtatgtggtaacatcacatgcaagttacaagatgtcagatgcatctgttttcgtcatgcactttccatccatagatagaacccatattcaggaatgaacccaggatgaataatgaggaatctaggattctaattccaactttcctcatttcacactgactttggggactttttacattacagagatttggtcttcccatcggtaaaatggggctaaaacctccaacctgctttcctgccttgtggggactgctgtgcaatctctccacatatgaaagtttatcctctagggaagtaaaacatcagcggtttccagcatgttgaagaacagtgtttcttacatcattcctccacccctagggttttgtagggagggtgagtggatggggctttggaccctccatagctcccaaacggtcctgtgtcatattgggcttcccgtaagactgtattttataaaaacgctctgtaacaagaaggaatggaggcagagaaggaaaaaaatactcttcctgaactagctatatacatggggagccctaatgcacacatcttggattagaaactccaggcctgggcatacgaacttttttaactaaaaaagtaatatctgttggatgtaaaccatgtgtagcttaatgtgtttttctcatagaaaacatgttttctcatgttattttattgagatgaaattcacaagacataataactattttaacccatttatgctgaatattgcaaagttttttatgtgaaaaatcaaaccttggtgatgaccttgaacagtaggatataaataactcctgcaagcttagcgttccaataatggaacactaggcataaatgggttaaagtctatcatttagtggcatttggtgtgttcacaatgttgtatgaccaccatctctctctagtttcaaaattttttcatcatctcagaaacacaccctgtatccattaagaagtcactccccactacccatctctccatcccctggcagccactaatttgctttctgctactctggatttgcctaccctggacatgtcatataaaaagaattacattatatgtgacctttttgtgtctgcctttttccatgtagcataatgttttcaagattcattcaagtcatagcatgtgttgtaaatcattccttccaatacttaataattttcatggtacttttaatctactttagattttttatgataggaagtttcaaacatgtgtaagtagagtaatagaatgaatccccaagtacccgtcactcagatccaacagttagtatttatttcaccaaggcctgttattttttgataaaagtgctctgtgacaagaaggaattaaggaagagaaggaaaaaaactcttctggagctatctgtatccatgtgggggagccctaatgcacacatcttggattagaaactccactgtcctcattgtttcatctgggtgatgaaacacccagattattttgaagcaaattctagacatcatgcccactccctcctgcccagattattttgaagcaaattctagacatcatgcaatcttacctgtacatatttcagtaaccatgtattgtttggaaaggctcctggaaattcagatgcacagtactcagtaagaatcacccaataagccagctttagtccacatgctcaggcagcatgtctttgaagtctgttttaagaggctcctcagtgactgatttgaagccaggcttgggaacctcaaagatagagtgtttattggttttgaagtcaccttgatcatctgactcttggcagatttatttgccatgattttgttcattgcctttccaacctgtaacaggatagagagtgctgttgactgggtatcctggcagccctggaaattccccagaagagggctttggcagtgattggcttagcaaggttaatgcgttccagccaacctaagtataacagacttcatgggagcagtgtgcagggctggacactggggctctagtcctgctcctgcatctgcaccctgcgttttccacctcacccctgccttttagtgcaagactcttagtgcacccctgcgtcacccctgtctcttagtgcatttattgcctttgcaatgtcgctatgtccacaccagatggcacctttgttccatctaactttccatctttcctaggatgctgatcctcccgctggcttccagacagacctgggacttggcagtcatgccgggtgatggtgttcctgcggagaccctcagttgtcctattccttcctagcttccctgcaataaaatcaagctgcttttgttggagatgttgtcttgcctggtcttggtgttgcttgctcacatgtaggtggttatgcttacttgggttggagttttgagagttcccacctgggagtcagacaccctgtagattctgattctttgctgtgtgatctttagcaaatcacttcccctctctgggcctcattttttcctcacctataaagtggaggcattgacccagaacagtgatcccctttcttttcaccagtttcatagactctatattttgaaaaaatttgtctatcaagtgaattgcacaagagattatcaaatgttaagcaagtggaatagtaggaagaggctgtggagacaaactgcctgggatagagttcaagctccagtacctcctagctgggccacttaacctctcagtgtccacagacaaaatgtgatgatagcatctactgcaaatggtggttgtggggattaaatgaaatgaaacatgtaaattaattacagcagtgattgctggttaaaaaatcactcag

SEQ ID NO: 107998 - DNA, 591 bp, Homo sapiens
  Payload ID: 1204
  Gene Symbol: ATOX1
  Gene Name: antioxidant 1 copper chaperone
  Uniprot ID: O00244
  ENST ID: ENST00000522710
  CDS Start-End: 106-312
ctctagtgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggtgggtaaggccccagcacttgctgaacaaacctacagctcacacctctcatcagagcgaacaccttggcctttgagagcttgagtggagcgggagagccctctgggttcttttcaatccactgtccaccttctttggagtggttacaaatattttattattgtctaatgcaaatcacaagttcagggaattcttacagaccctgtgagtggacagagcactgtgtaatgtct

SEQ ID NO: 107999 - DNA, 466 bp, Homo sapiens
  Payload ID: 1204
  Gene Symbol: ATOX1
  Gene Name: antioxidant 1 copper chaperone
  ENST ID: ENST00000520382
  CDS Start-End: 103-282
gagcacagtgacaatccagactcagcggtgtttagagacttggaaagagtttgagaagccacttagccactttattttcagaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 108000 - DNA, 724 bp, Homo sapiens
  Payload ID: 1204
  Gene Symbol: ATOX1
  Gene Name: antioxidant 1 copper chaperone
  ENST ID: ENST00000522314
  CDS Start-End: 361-540
gagacaaagctcatagctcaagaatcagtgttttgaaggtaggactgggaaaaagcattttaaactagatctccaggtgattctatttactatgtgccagacactgctaaaggatttatagggatgattccattgaatacaacttgtgaggtagaaactcttagctactctatagttgaagagacgggctcagaaacaggcttctgatgagtctgatgccaaccaggtcctgcccagtctctctgtcttctgtcttgaccctgagtgggcctgtctgctggcactgtgtgggggtcactctacagggctcgggtcatggtccccctgtgtttgtttcagaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 108001 - DNA, 749 bp, Homo sapiens
  Payload ID: 1204
  Gene Symbol: ATOX1
  Gene Name: antioxidant 1 copper chaperone
  Uniprot ID: O00244
  ENST ID: ENST00000524142
  CDS Start-End: 359-565
gcaaaaccgaaggcgcttctgcgacgcgcggaccgcaagactccaatcagactttagtgctgcccccaccctaaacgaaagcctccttctggtccgaaccgactggatcccttggccaggggaggaaaaggccgggtgaccacgggcccggcccgcagaaaggaggcggcgcggccggcagggatcaggactggagggggcggagcctccctcgcggccgggcccggagtgggaggggcctccgggaccaggcctctagtgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 108002 - DNA, 2362 bp, Homo sapiens
  Payload ID: 1205
  Gene Symbol: ASF1A
  Gene Name: anti-silencing function 1A histone chaperone
  Uniprot ID: Q9Y294
  ENST ID: ENST00000229595
  CDS Start-End: 195-809
gaaataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccaaatacaatatcgggagaaaatacaaactccctgtgtttaagaataggggattacaatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatattttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaa

SEQ ID NO: 108003 - DNA, 2059 bp, Homo sapiens
  Payload ID: 1206
  Gene Symbol: ASF1B
  Gene Name: anti-silencing function 1B histone chaperone
  Uniprot ID: Q9NVP2
  ENST ID: ENST00000263382
  CDS Start-End: 501-1109
cgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaatga

SEQ ID NO: 108004 - DNA, 746 bp, Homo sapiens
  Payload ID: 1206
  Gene Symbol: ASF1B
  Gene Name: anti-silencing function 1B histone chaperone
  ENST ID: ENST00000590835
  CDS Start-End: 158-403
gaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacc

SEQ ID NO: 108005 - DNA, 765 bp, Homo sapiens
  Payload ID: 1206
  Gene Symbol: ASF1B
  Gene Name: anti-silencing function 1B histone chaperone
  ENST ID: ENST00000474890
  CDS Start-End: 119-616
gagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccaggtggggcctgtttccacttcctgcttcccacaaggccgttctttatacttggggggagttcagccattcaaattgagagtcaaggtcacttcttaaggttttcaagtaatattcagttcttacagtactgtgttagaagaggagaaaaagacctttgtctctcaaaggcatgtcttagagaattaagattaggccagcctgggcaacatagtgagaccctgtccctaacccccgcaaaaaaaaaa

SEQ ID NO: 108006 - DNA, 587 bp, Homo sapiens
  Payload ID: 1206
  Gene Symbol: ASF1B
  Gene Name: anti-silencing function 1B histone chaperone
  ENST ID: ENST00000589468
  CDS Start-End: 134-280
gcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatc

SEQ ID NO: 108007 - DNA, 769 bp, Homo sapiens
  Payload ID: 1206
  Gene Symbol: ASF1B
  Gene Name: anti-silencing function 1B histone chaperone
  ENST ID: ENST00000592798
  CDS Start-End: 98-529
cctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacgacctggagtggaagatcatttatgttggctcggctgagagtgaggaatttgatcagatcctagactcggtgctggtgggccctgtgccagcagggagacacatgtttgtctttcagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgtt

SEQ ID NO: 108008 - DNA, 2857 bp, Homo sapiens
  Payload ID: 1207
  Gene Symbol: AZIN1
  Gene Name: antizyme inhibitor 1
  Uniprot ID: O14977
  ENST ID: ENST00000347770
  CDS Start-End: 767-2113
aaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcat

SEQ ID NO: 108009 - DNA, 4721 bp, Homo sapiens
  Payload ID: 1207
  Gene Symbol: AZIN1
  Gene Name: antizyme inhibitor 1
  Uniprot ID: O14977
  ENST ID: ENST00000337198
  CDS Start-End: 1165-2511
atcaccgagggcgggcgcctcagcccgggaggacactccccagggtaaactacaggcctcacaaagcggagggagctggacgcgaaggctcggcagcggcgccgacaggcttaccccaggcccactctaggccgcacagggttcgcgccacctccggcccaggacagctctcagacgctgccagcgtggagctcgacccggctcacaatgcgctgggccccgcagcgtgagcgcaggcgcccgagaggcggcgggggtcgggcggacggcgcgctccagccgagccgcctccctctctcggcccacacccgcgcggccgcccttcgcctgccggggagctgcgggtggctggagggcgggaagcgaccggccagtctgcacctgcatgacccggtcgcgcgccgacccctcccctctctctcccgggctcagtcctccttcctcttccgtccccctcccttttctccgggctgcaaccgggttccgccccgctcgcgcggctgcccggccagctgtgatgtcaccaggccacgccccctaatataaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctggagaaattggctttacgatgaacatgttagacattggtggaggattcacgggaactgaatttcaattggaagaggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggagtagaaaaaaccggaagtgatgaaccagccttcatgtattatatgaatgatggtgtttatggttcttttgcaagtaaactgtctgaggacttaaataccattccagaggttcacaagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctca

SEQ ID NO: 108010 - DNA, 773 bp, Homo sapiens
  Payload ID: 1207
  Gene Symbol: AZIN1
  Gene Name: antizyme inhibitor 1
  ENST ID: ENST00000518353
  CDS Start-End: 675-773
cttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgagttctttcctcatcatccataaatgtcattcattgagcatgtgatcagcttctcctagatagatgaaacattttgcctccaccaggagtgccttgatcctggtgagatacactttagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacatacc

SEQ ID NO: 108011 - DNA, 660 bp, Homo sapiens
  Payload ID: 1207
  Gene Symbol: AZIN1
  Gene Name: antizyme inhibitor 1
  ENST ID: ENST00000520402
  CDS Start-End: 370-660
acacatggaggttcctggagagtggcgggcccagggagggcatggaggtttcacatccctccccctgtatcttgccctatgtgtctcttcatctgtatccttcgcaatatcctttataataaaccagtaaacacagggcgaactttctgaccaagtatacaactacccagagggcctaggagaagtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaaaatgaaatggcttta

SEQ ID NO: 108012 - DNA, 680 bp, Homo sapiens
  Payload ID: 1207
  Gene Symbol: AZIN1
  Gene Name: antizyme inhibitor 1
  ENST ID: ENST00000521536
  CDS Start-End: 186-680
gtgctgtatagagagcagttcgacttcaacgctgagccaccttgggaacctagctgatgataggggggttccatctcccaacttgtccattttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctgaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaaggtcttactacatattgcaacagaagataatattggaggtgaagagggtaacatgaagtttggcactaccctgaagaactgtaggcatctcttggaatgtgctaaggaacttgatgtccaaataattggggttaaatttcatgtttcgagtgcttgcaaagaatctcaagtatatgtacatgctctatctgatgctcgatgtgtgtttgacatggctgga

SEQ ID NO: 108013 - DNA, 2182 bp, Homo sapiens
  Payload ID: 1208
  Gene Symbol: AZIN2
  Gene Name: antizyme inhibitor 2
  Uniprot ID: Q96A70
  ENST ID: ENST00000294517
  CDS Start-End: 588-1970
tgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggagcttgcggcccccacccaccgcgtggcgtccccaggcacgcctagaattctagcacctcaggatcagtccagcccccatttacaattggggaaactgcggctccgaaagggtcagagggtacccgaggtcaagcagtagagagcggactcgaacttaagctcttgctcttaggctgagacgccttgatgtggccaccggctaccctctagtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttcca

SEQ ID NO: 108014 - DNA, 616 bp, Homo sapiens
  Payload ID: 1208
  Gene Symbol: AZIN2
  Gene Name: antizyme inhibitor 2
  Uniprot ID: Q96A70
  ENST ID: ENST00000373440
  CDS Start-End: 1-615
atggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtagc

SEQ ID NO: 108015 - DNA, 1443 bp, Homo sapiens
  Payload ID: 1208
  Gene Symbol: AZIN2
  Gene Name: antizyme inhibitor 2
  Uniprot ID: Q96A70
  ENST ID: ENST00000373441
  CDS Start-End: 1-1443
atggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggccccactaccaccccctcacattgctacttgtgctgcctctgaaccctcccctcctgcagaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtga

SEQ ID NO: 108016 - DNA, 2048 bp, Homo sapiens
  Payload ID: 1208
  Gene Symbol: AZIN2
  Gene Name: antizyme inhibitor 2
  Uniprot ID: Q96A70
  ENST ID: ENST00000373443
  CDS Start-End: 319-1701
ggctgctgggctggcggggcgcaggccgcgggacccgagcccggggaagcgagagagcggaggcgccgaggatccgattcactccctggggagacctatgggccgaagccgtgtaaatgcgttttaagaggcctcggctccgcaactgccactcctcctcggggtgttgcacaagtttcgaggtcaccggcgaccccccctagcagcgcgcctggctctggcccccgcgaaggaggacggagtttgtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgttcttggggtctcctttggtctccttcccacctttgtaaatataatgcaaataaataaatatttaggtttttaaaaactg

SEQ ID NO: 108017 - DNA, 891 bp, Homo sapiens
  Payload ID: 1209
  Gene Symbol:
  Gene Name: AP000275.65
  ENST ID: ENST00000431216
  CDS Start-End: 1-891
gggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaac

SEQ ID NO: 108018 - DNA, 929 bp, Homo sapiens
  Payload ID: 1209
  Gene Symbol:
  Gene Name: AP000275.65
  ENST ID: ENST00000553001
  CDS Start-End: 39-929
gggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaa

SEQ ID NO: 108019 - DNA, 1000 bp, Homo sapiens
  Payload ID: 1210
  Gene Symbol:
  Gene Name: AP000295.9
  ENST ID: ENST00000433395
  CDS Start-End: 1-1000
gtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtga

SEQ ID NO: 108020 - DNA, 753 bp, Homo sapiens
  Payload ID: 1210
  Gene Symbol:
  Gene Name: AP000295.9
  ENST ID: ENST00000432231
  CDS Start-End: 1-338
ttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtga

SEQ ID NO: 108021 - DNA, 1078 bp, Homo sapiens
  Payload ID: 1211
  Gene Symbol:
  Gene Name: AP000304.12
  ENST ID: ENST00000429238
  CDS Start-End: 352-1078
aaggagccaagatggccgaataggaacagctctggtctacagctcccagcgtgagcgacgcagaagacggtgatttctgcatttccatctgaggtaccgggttcatctctctagggagtgccagacagtgggcgcagatgcagtcgaagccctgtggctccaccccgagggtccagcccttaccactgctaagaactacaactcccagcccgagggaggtctctgcgcctgcggcctgacgccctacgcctacacttcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctac

SEQ ID NO: 108022 - DNA, 1050 bp, Homo sapiens
  Payload ID: 1212
  Gene Symbol:
  Gene Name: AP000322.53
  Uniprot ID: A8MWV9
  ENST ID: ENST00000450895
  CDS Start-End: 128-547
gtgcagctcaactgcagtaggactgattcttccctaggagacggagttctcctttcatcatcttccccttctgtgcatggtagccgcttgaacttgcccctccaagagtcaaggacaagaccaccccatggaatgggccaagtggactccccatgaagcctccaaccagacccaggccagcaccctcctggggctcctgctgggtgaccacacagaggggaggaatgacaccaactccaccagggctctgaaggtgccagacggaaccagcgctgcctggtatatactcaccatcatcggcatctacgcggtgattttcgtcttccggctggccagcaacatcctcagaaagaatgacaagtccttagaagatgtttattactcaaatctgacctctgaactcaaaatgacagggctgcagggcaaggtcgccaagtgctccaccctgtctatcagcaacagagctgtgctgcagccctgccaggcccacctgggggcaaagggcggaagcagcgggccccaaaccgcaaccccagagaccccctgagagtcaaggccaggaggccttccctagggtggccccagacttcttggaggggagcagctttgggtttacttggagcccttgagggggactgggggtgcatcactgacaaggggtgcttctggctgctagtttgtgaccagagccagccacccagttccttctcagacttccaggtgcttcgagaagagagagcagggcagcggtttctagccaaattcaatcttcactggcaaaacctgtgctctggggaggagcactattccactgttctcggaggaatccgggagactcctgggggcatacaaggaggtgactccttgtcgtggaaagaagaatgaacttggagtcagttctgggttaaaattcaacttctggggagtcacataaactgagcagcttagttgctcacctgagacatttagggtttggagacagatggttttaaaagtctattttatttgaaagactctagcttgaatataggaccaaagttgttaatatca

SEQ ID NO: 108023 - DNA, 747 bp, Homo sapiens
  Payload ID: 1213
  Gene Symbol:
  Gene Name: AP000349.1
  ENST ID: ENST00000598975
  CDS Start-End: 1-747
atggggccccagcacccttgcttcagtgccagcccctggaaggaacctcacaacagggatacagcaaggacactccagttcccccagtcctgccatggtgctaccctgagggacagggatggagacagggcagccaggtttgccaggacctgcatagcgggcccaagactgcccttcctcttaagtcatgccaaagcctccctgcccagtctgagacagtcgctggcaggtgaccacgacctgcgtggccctcccggcagttgtcatggtggttgtaccccaccccatccccctgaggagacatgggctcagtcccatgcctggtgcccacagccacaaagatggccatgggtctctagcctgatattcgtggcctggcaggggtcagcacccctgagggcatccaagccatggtcagaggaaagtgttggcaggctcggcacagccaaagaagtcaggacccacgagacgggggaagccttccagagccttcaccttcacagggtcaaacttccagtagaggcggccgcgcaggaagtaggcatagccatcagcatcctggaaggcagcgtcgatctcagagggcacccctctccagtcagtggctgcggggcacgggactgtctacacgccgggtgctggggtggaaacgccagtagtccctgcctcggaagaagtagatcttgttcttctcgggaccccagaccaaggcagcatggaccgggaacctcaccaggcccagctcgg

SEQ ID NO: 108024 - DNA, 747 bp, Homo sapiens; identical to SEQ ID NO: 108023
  Payload ID: 1214
  Gene Symbol:
  Gene Name: AP000349.2
  ENST ID: ENST00000624319
  CDS Start-End: 1-747

SEQ ID NO: 108025 - DNA, 788 bp, Homo sapiens
  Payload ID: 1215
  Gene Symbol:
  Gene Name: AP000350.10
  ENST ID: ENST00000433835
  CDS Start-End: 1-630
aatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 108026 - DNA, 788 bp, Homo sapiens; identical to SEQ ID NO: 108025
  Payload ID: 1215
  Gene Symbol:
  Gene Name: AP000350.10
  ENST ID: ENST00000626965
  CDS Start-End: 1-630

SEQ ID NO: 108027 - DNA, 111 bp, Homo sapiens
  Payload ID: 1216
  Gene Symbol:
  Gene Name: AP000351.1
  ENST ID: ENST00000615157
  CDS Start-End: 1-111
caagtcgcctttggccaggattactgcaccaccgtgcccagcccagaatattattctaaaacacaatcagagcactccatacctgctaacagtttaaagccaagcacctag

SEQ ID NO: 108028 - DNA, 375 bp, Homo sapiens
  Payload ID: 1217
  Gene Symbol:
  Gene Name: AP000687.1
  ENST ID: ENST00000624569
  CDS Start-End: 1-375
atgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaataaaaagtctcccatgtctacttctttctacacagacacagcaaccatccgatttctcaatcttttccccacctttcccctctttcgattccacaaaaccgccattgtcatcatggcccgttctcaatgagctgttgggtacacctcccagacggggtggtggccgggcagaggggctcctcacttcccagtag

SEQ ID NO: 108029 - DNA, 559 bp, Homo sapiens
  Payload ID: 1218
  Gene Symbol:
  Gene Name: AP000721.4
  ENST ID: ENST00000535431
  CDS Start-End: 62-556
attttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatgggaaaagaaaacggaattggctccaggaggatctgcaatcaccaccgggaactttgggaggctgggaagatggagccaaaccaatgtgtggggtggaggtgcggatctggggcggccggcctctcctacaggtctcaggtccgcaggcctggcgtgccagcacctgccacgggactggaagcccattccttgacaacgcctaaggggatcccgttgctagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactg

SEQ ID NO: 108030 - DNA, 826 bp, Homo sapiens
  Payload ID: 1219
  Gene Symbol:
  Gene Name: AP000866.1
  ENST ID: ENST00000624557
  CDS Start-End: 126-329
aattgtatctgtgtaatgttaaaacaaacgaaataaaatagaaggaaaaactttctgagtttcaaaaacaacagactagtactctaaagaactctttaaaacaattaactgttaggattgcagttatgattggatattatttaattctgtttctgatgtggggttcctccactgtgttctgtgtgctattaatatttaccattgcagaagcttcattcagtgttgaaaatgaatgcttagtggatctgtgcctcttatgcatatgttacaaattatctggagttcctaatcaatgcagagttcccctcccctccgattgttctaaataattgaaagatgtctgctgtggaaaaaggcatgtatttaaatctgtatgattctcaaccatctttagttgggaaaggtccttgaaagccaatggaaatactttttttttttcttggcactaatcaagtgagtgttaccttttcacttagtaggatgtgttgttacgctagtaaaatagaaacctgtgtttattctcaggtattttagaaacaacagccatcattttattttatgtgtgtgttcttggctgtattcataaattatatattttgggctatcaaatattacttcattcaatataaataacaatagtagaagttgtttacttagatatgctttctagttgcattttctcagcctatgtaagactactttgttgtaatagcctttgaaatttacagtactgtctctctactatcttcagattacttgattcaaataaaccaattatgtttgtaattgatattaataaaaccagaataaaagttcatatctaccc

SEQ ID NO: 108031 - DNA, 42 bp, Homo sapiens
  Payload ID: 1220
  Gene Symbol:
  Gene Name: AP001888.1
  ENST ID: ENST00000627463
  CDS Start-End: 1-42
ttgagcattaggcaatggaagtccctcgacactccaccaggg

SEQ ID NO: 108032 - DNA, 571 bp, Homo sapiens
  Payload ID: 1221
  Gene Symbol:
  Gene Name: AP002884.2
  ENST ID: ENST00000532699
  CDS Start-End: 6-428
acgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaaggtacaatcattggtttgatgggatggcgctgcttcaccagttcagaatggcaaagggcacagtgacatacaggagcaagtttctacag

SEQ ID NO: 108033 - DNA, 566 bp, Homo sapiens
  Payload ID: 1221
  Gene Symbol:
  Gene Name: AP002884.2
  ENST ID: ENST00000531744
  CDS Start-End: 6-428
acgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactgtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagttttcaaaaggtacatgggaaatactcctcagaaaaaagccgtctttgggcagtgtcggggtctgccatgtgttgcaccgctg

SEQ ID NO: 108034 - DNA, 942 bp, Homo sapiens
  Payload ID: 1222
  Gene Symbol:
  Gene Name: AP002962.1
  ENST ID: ENST00000623963
  CDS Start-End: 1-942
atgcaggaggcagatgctagcattaagactgcggaaacaaagggaagaacttggaagtatcaaaacatagagcctgggggaggacctcagacctctgggaaagggggctttggcagtctggtgctggtgtttctggggcagagggtagggtgtaacgagactggttccatgaatttggaaaaactgcaaactagacccaacatgactatttttacccgaaacaacatagccacgaatttctcctcctcctcctcttcctcttatttttcccctcctcctcctcctgtcctccttcccctcctccttcttctcccccaacttttttcttcttcttcctcctcctttttcttctccttttccccttctacttctcctcttgtttctccttgttttttctcttcctcctcctccttttgcttctcagtttctcttcttccatcttcttccccaacctccatgactaagtttccaaaagcagttacgacaaaaataaaaactgacaaaagggacctgattaaactaaagggcttctgcacagcaaaagaaactatcaacagaacaaacagacaacctatagaatgggagaaaatattcacaaactatgcatccaacaagggtctaatatctagaatctataaggaacttgggcaatctgacaagcaaagaccaaataaccccattaaaaagtgggcaaaggacatgaacagacacttctcaaaagaagacatacaagtggccaacaaacacgaaaaaatgctctcaacatcactaatcattggaaaaatgcaaatcaaaaccacagtgagataccatctcatgccagcaaggaaagctactattaagaagtcagaaaataacagatgttggcaaggctgcagaggaaagggaacgtttacacactgttggtcgaaatgtaaattaaaatgtaaatgtaaaatgtaa

SEQ ID NO: 108035 - DNA, 711 bp, Homo sapiens
  Payload ID: 1223
  Gene Symbol:
  Gene Name: AP003419.11
  ENST ID: ENST00000543494
  CDS Start-End: 46-288
gcctccgggagaggagccgcacccggccggcccggccccagccccatggacctccgagcaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttat

SEQ ID NO: 108036 - DNA, 308 bp, Homo sapiens
  Payload ID: 1224
  Gene Symbol:
  Gene Name: AP005242.1
  ENST ID: ENST00000623604
  CDS Start-End: 86-274
cttctgcaaagatctatttgtttagccatgtgcaaatattgccctaaaatgttcacaggttccaggataaccagatgactgaggaatgttgaagattgcagtgatggaagtgcctcagtcagcctggaagactgtatggatggaggttgcctggccacactgtcatgtccctctctccctgaaaaagagacacatttgcctttgggcaaggcaatacatacatttggtctatgtatacactttggtctatgcattctgttatttaacattctaataatgttgatgaccttaaaatatgcttgacaatg

SEQ ID NO: 108037 - DNA, 2175 bp, Homo sapiens; identical to SEQ ID NO: 103610
  Payload ID: 1225
  Gene Symbol:
  Gene Name: AP006285.1
  ENST ID: ENST00000617253
  CDS Start-End: 1018-1614

SEQ ID NO: 108038 - DNA, 2175 bp, Homo sapiens; identical to SEQ ID NO: 103610
  Payload ID: 1226
  Gene Symbol:
  Gene Name: AP006285.2
  ENST ID: ENST00000624434
  CDS Start-End: 1018-1614

SEQ ID NO: 108039 - DNA, 4499 bp, Homo sapiens
  Payload ID: 1227
  Gene Symbol: AAK1
  Gene Name: AP2 associated kinase 1
  Uniprot ID: Q2M2I8
  ENST ID: ENST00000406297
  CDS Start-End: 378-2969
gatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagaaaccagcaattgctcagttccctgtggtgtcccaaggaggctctcaacagcagctaatgcagaatttctaccagcagcagcagcagcagcaacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgctgaaaaaaggaagggtgggcagactgtggactctggcctcccgcttctaagcgtgtctgatcctttcattcctcttcaagtacctgatgcaccagaaaaactaattgagggactcaaatctcctgacacttctcttctgctccctgacctcttgcctatgacagatccttttggtagcacttctgatgctgtaattggtaaagtcatcatctctgtttcttcagtcatgcatgatatgtgtgcctgtttcaagaatgacaagtacctagttaaccaatccctggggaatagccctgccaccccagaagccaaggctatttaatctcacttgtatcactccaaatgaagtgttttccttgcttttcgggggtacaacgtctattttttgcctttcttgatatctggagatttctagagtggatctcttatgaatgaggaggaatgtggaaagtttcacatttagttagaagaactttaaaaaattggtttctaactagactacctttactgaacttaatgaaatttagcagattcttcttttttttttttttgtttgagacagagtttcactcttgttgcctaggctggagtgcaatggcaagatctcagctcactgcaacctccatctcccgggttcaagcaattctcctgcctcagcctcccgagtagctgagattacaggcatgcaccaccatgcctggctaatttttatatttttagtagagatagggtttctccatgttggtcaggctggtctcgaactcctgacctcaggtgatccacctgccttggcctcccaaagtgctgggattacaggggtgagccaccatgcccagcccagattcttctttagaaggcccatgtacatccagctgcagtgggacgagcctgggaagcataggaagaccccatccctacaaaaaaaatgttgttagttagccaggtgtgggggtgcacacctgtgctaccagctctttgggaggctgagacggaagatcactttgagccagggggtttgaggctgcagtgagccctgatcatgccactgccctccagcttaagtgacagagacccatcttaaacaaaattaaaaaatttaaaaaggtccatgtatataccaagtatcagtaactgagaaaacattttgcccactggttaagccccataaatagaatccagggcaggggcttggtctgcttcctctctcacattttcctatgttccaacagcaaggcaggcaagatttgcaaaatgtccaaggcccctgtactccaggagggtccaatcatgaggcacctaataatgcctttgggcagaaagtcctagaactcagaagtgccatgaccttgcataggggtaggcctgcagctgaggggtgtcacgtggtgcaaaaggcctcccagctacatcctgggatggggtttgagatggattaatggcctttgcatggcacagaggatgtttgcccccaggtttatcccttaataaaagtgaaattaccagaaaaaattaaggtgcctttcagcccatctcttctgacatggaagaggtttgctgagcggcttatgttctgaatttgtttatgagaactgatcattagtgagactggccacagtatttaaccttgcacatgcatgctcagtgaagcctagacattcagagcagcagaaataaagtaacttatttttctttccaccttgcctgagactggcattttagagacctgttaaaagaaagtcttcacatggctgggtgcagtggctcacacttgtaaccacaggactttgggaggccaaggtgggatagatcgcttgagctcaggagcaagacaccatctcaaaaaatgagaatt

SEQ ID NO: 108040 - DNA, 2606 bp, Homo sapiens
  Payload ID: 1227
  Gene Symbol: AAK1
  Gene Name: AP2 associated kinase 1
  ENST ID: ENST00000409068
  CDS Start-End: 315-2339
ctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagaaaccagcaattgctcagttccctgtggtgtcccaaggaggctctcaacagcagctaatgcagaatttctaccagcagcagcagcagcagcaacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggcagaattgcttgacccagggaggcagactttgcagtgagccaagattgtgtcattgcactccagcctgggcgagaagagcaaaactccgcctcaaaaaaaaaaaaaaaattgtcactggagacatgatgggtggagactctacataccttctttgaatacagaaacggatgcaaacacatgcaaattacttttttttttttttttggtgatgcatgaaaaaactttgacttgtggattacattaattattagtaacagttagattctgccgacttgtattacagtagggtcttatttccttaaag

SEQ ID NO: 108041 - DNA, 11345 bp, Homo sapiens
  Payload ID: 1227
  Gene Symbol: AAK1
  Gene Name: AP2 associated kinase 1
  Uniprot ID: Q2M2I8
  ENST ID: ENST00000409085
  CDS Start-End: 378-3263
gatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagaaaccagcaattgctcagttccctgtggtgtcccaaggaggctctcaacagcagctaatgcagaatttctaccagcagcagcagcagcagcaacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgctgaaaaaaggaagggtgggcagactgtggactctggcctcccgcttctaagcgtgtctgatcctttcattcctcttcaagtacctgatgcaccagaaaaactaattgagggactcaaatctcctgacacttctcttctgctccctgacctcttgcctatgacagatccttttggtagcacttctgatgctgtaattgaaaaagctgatgttgctgttgagagtctcataccaggactggagcccccagttccccagcgcctcccatctcagacggaatctgtgacctcgaatcgcacagattctctcaccggggaagattccctgcttgattgctctctgctctctaaccctactactgaccttctggaagagtttgcccccacagcaatctctgctccagtccataaagctgcagaagatagtaatctcatctcaggttttgatgtccctgagggctcggacaaggtggctgaagatgagtttgaccctattcctgtattgataaccaaaaacccacaaggtgggcactctagaaacagcagtgggagctctgagtccagtcttcccaacctagccaggtctttactgctggtggatcagctcatagacctgtagccgtgacccagtagcagatgcagttctgtaaccttcataccgtaaaatacattttcattacggagttatgaaaaaaatgatttttttaaaaaaatctgcaaataaggggccctccagcccttttctcctaccccttgccttctcctgtagaaatgataaggaaagaaaatcactttggccctccagatattccttggccagttcctccttgttagtttgctgtgttttctcattacccttcttcaatagcattatcttaaatcaagcactagatgccatgagcttcacctctgctggaatcaactccaccaaaagcttaactgtaactgaaactagtgaattgacacttttgtctcgttcttgctaggaatggcctcccagatcaattctcccaacccccgtctcctttggccagatgctgatgaatgtatttccctgtttttgctttttatcctgatgcattatcatgaggacatggctacttcagttggtcttaactctaggcagtagcctggagatgggtgtgtggtttaagaaagggtaaaacttactgactggtagtatatatttgagaagagaaattgagcccagctctagccaaccaactttgaccttgtttgatcatagacttagccaagggattttacaccccatgcaacctgcccagcattcgtccagctttctggcttccattgaaccgtgatttctcagatctggagacgtgactgcaagtatttgagatccttggatacaatgtgtacgttatataaatcccaagtattgccattccttttcatgttaactgttccaagtgggatctcagaattagaccaaaacaagacggtggtaatatgataccttttattagaagacttttcactggggcgggggtggggggaggatggggaggggaaggaattgtagcagaaacagatgtatttttcttgtgatttttattttgaatcaaatattgtaaattgtgtataaatgaagatgctgaatagttctgtttccacttggcatttcaagtctgatatcaggtgtctgtacagggttttgatttctttcccttgtataactacacaacaatcctacagtgtaacatatggaatcattttgaatagacttgtgtgctataagctttcagcaggtcctctgtctctagaataagcatgttgtttattttcagataatcagaaataagtgtgctgacaagctggacacaatctgggtgtgcccagcttacctttctttctgatgtttaaattgaaggctgcagccaatggaatatgttcagctggttttccttggcttcctagattaaaaaaaaataataaagcatagttctttattaactttaggatattgttcataaaataaataaaggcccctgcactaacatgacaacatgcctcatggtcaccctctctatatgtacttactcattaaagtgtattttatttccttatgtggaaagcacttttataaaatcacccttttgaaaagaagtgggcacagagaaccccactcctgttcttttcctctagtgccattgtccatcatcaaaagggaaactcttagttaatcagatctgtacaaataaaattccaagtccatttgcttgttttgctatctagtacttttgtttcttcttcctcacatttgcactttatgggggaaaaaagtttaacagcaacaacagcctataaaacactgcattctggagggcaaggtttgaccctaggaatgtgcgagtagcctttgaaaggcattggaggaaaagtctgaatcttccagccttccttctgtctttaaatacttcccgtgctggctgaaacaagatgagctaggtaaaggcctctagttgaataacagaccatttccaaaactgagagaggcacaagcttcctgccgaggattaaaaagcaaaagatatccacgaagggctctctgtggttggatagcagtgaaaataggacttggtttacccctttatggacaggaaaattgctgcaggtcagaattgtattctctttcctggacatagaaagaatgtataaattaatgaaggaaatgtttatttttaaataagaataatgtttgagttctatgttttcatatttgatttttttcgtatatacatgttagaaatataatgaaatatctagtttctcaatttaattgaaactatgaagagtacagtttagaaattaggtatctctaaattgttcttttcatatattacccataattacattgaaatatattatctagtcatttggctcagtaaagcttaatggaggcagttaatgaaaatgagcagactagaagccagagacggcagtagaagcctaagggagataatgacaagaaattgtcttgggcttatttagagtaaggcctcctcaaaggggagaactatttttctgttaaggaacacatatgagtgctttggtaaacggagccttccttggtttagagcatcatccctgagctgaaagagtttatttgagttgagcatagtgtcctggtacctgtggaatcatagcctgagctacaaagggacctttgagaccatcctctagtccaccatcctcttcattttacaggtgtgggacctgagctggattgaacagggtcgggggagaagaggcctgggcaggacaggccacctgggatctcatcctggcccttgccagccactggctgagtgaccttcagcaggcacttcacctctcagagttgctgttccttagagttatacgatgggtttggactagatggtctttaagattatagaagtatagggtcctaagtatatattattatattgagaagggctatgaaggatttatataatcctgatgttcttcagttatcttctgtagttcctgctattacggtagcagtgtttacattttaaagaattataatgggcttttactaacttgctctttcttgattatctgaatagaagcctaaatcataatcttagagattttcctttttaagtattacagaaacacatgcgtggacacacacctacctattctaataaaatggtatcagaagatttctttttaaatgtataatcaggcatctaccagtttaaaacgggcaaatactataagcatatgtttctgatttgcttttattccagctatgtaagaggagtaactatagcagaaaacatgacaaattgatttttccctttacaacattcaaatgagtcccaatgttttcaaaaatacatacctcagaggagataaggcttaagtggacacttctaagtatgattataattattataattaatgatttctttagcagacatatcagaattttgacatctaattaagtgttgttcccctcaatgtcatctagttttacttaagaagttaatacttattctaatgatgctgccatccttaaagttatttttgaaactcctctccttagaaataatatcaaggaaggtaataaggtataagaaaatcagctatattatttaattagtatcactttgagaaagcacctggaagtatattctttctttgtctactttttctactactcttggttctgagtaacatttagccatttccagaaagcaaattcaaccctgtaagatgaagagtggttactgttgaagacagtaaaaaggataatccacaaaaaattctcagagaggaccttataatagaaagtgaacatgattaagacttaatttctgtaattttctgaataaggaaacttctgtgattccttagtctttagaatggtttaaaacattgaaagatatgggtattaaaacacctctgaaagaagttgtcactttgttcagtgttatttgatattggacttcgctcttcctgaattagaattacacaacttggattgctaatacttgtggaaaaacaaacccaagaaacgaactactttctcaagatgtaatatttgttttattattaatacttttggttgttttgattacttatttcctactctcctgacagataattgatcaaccaatataaccttccccaggttaggaacagttctgccttcagcagtgctgtgggaatgaagggatctttggggctgacagcctatgatgtggagggatctgcactcagctaaataaatacatgctatagataccttgggccaaaataaagtctctcttgataaggtttttctgtgatttcccagagtccttaaccttctctgtctgcaagattatcaggctcccatagccactaactttgagctttgggatgaaaatgacaggattgcccagtgtgccgggttaagcaaattagaggctgcctggcagaacagaaaaactatcacatgaatatttagaatggaagctttcctgaaacactccagatactgcaaagctatctttattcctctctaaaggctataattttatcaacacaaagtcagccttttctttttccacattagtaatgtttctgaagttggatgtgcttagatttcttaaatcagaatgagtgctaggaaatctataacaagaaacctcttttgcttctcccagatttcctttcactaatacgggatagggaggctccttgggtaatgctaacctatgcaaagaagttaccaaatggtggtagttgctagaattaaagacacgttcttggttcacactttgatgtagtgacctgaatttactcttttcctgtgagtattctactctgccctattgcactctcctttgtcatgtggatgtgtgtttatcataggtctttaacgcgtccttcccaagaagacaaagcatacagttgtacatgaagatatcttatgcagtaaaaacgtgaaatttgaacattgctgcacaagtattgtataaaaaaaagtctgtaaagaactttcttatgtaaacatacaggggaataaagacttttatctgttcaaatgggagcatgatgtttagagatgtaaataacttaaaataagttgctcttttcctgagctgaaaacccacttttttgcagaaaggatttaatcacagtattgagtgacaataagtacctgggcacaagaaaagtatagctacacactgaggacatattaatgaatcatggctacctgagagagtaaaacccctgttttagtctcaaggagaataagacgcctgccagcctacactggatatgaccagactcagggttgtaaaatggagcgcaggtttgcagcttccctcctctaacttaatccctaatatacccaggccaacttaattaaacattttgtgttggcaagaataattttatccccagtgagaaaactcactcatttaattgcctcattggcctgagaggcacagctggccatttttggcttccatgaggtccctcatttcccagtcgtgggttttaatgcagctacctaatatatggtggaaccaaatgcttaattttgttatgtgagctagaaggtcatggtaattattagtttgatgtacgtctcttgatttccccagtttggttctaaaattttacgtttcaattgctgctgcatttccaagttcttgtgaagggatattttgctttctgtttactaactatatgtgagaaggcttcttctcaatgctccaagtcttcgttttctgtttttggcaagaatcatatctttgatactccctgtaaccgttctttcagtttttggtatgaggaaaagtaaacttctggtgttgtgtgatgtatttcattaaggaatatccagcctgacatttaagtcttcagattttaattctgtagggagcattctgatggccctcactatgtcaatcagatggagtttccaggggaaacccatcctaaatgattcagcactttgggttgctttggaagtgaatagggagctggtgaggatagttgccaagttgtcaggtattttaggaactccttctcttccctgaagcatgtgagttcttgctgaaatctacataatttggagcctcaaaatagactaatatggagttacccatattgaaagtgtcaacgtgcctaacctggcacacagtcctacatcagagcaagaaaaagaagtatgttttgacttcttgcttaattttatgtgtgaaaccaaaataaaaagaggcatgatccagtttgagggaattataacaaaaccctacgttaggctctatgataagtaagaccctgtgcagactatgaagccaggccctgggctttagcccctgaggtacaacaggcagtgtttactgagctctatggccacagggtatctgctatgacgtgccattggttaccaaaggaactgggtcaaggcatgtggttaggttagtataaatccttcaatgctagtaaagagactgcttcaaacacgttttcttgttgacacaatgctaccttcatataaaggaactgttcaccctgaaaacacattttccctgtaagaacacattcacatactcaaaaaaagacttttatctgccaacaagatttaatggttaccttctgtttctagtatatttggaatttatccttctctcgactaccttgtttctggtgctgccaccaccagaattccttaagggaatgtggaggtctgggcttcccccatattctctggcatttctttgcccttcagagtgccaggcctggagagttgcaaagtgtggttgctctccgcctcagccacactgtacctcctctaacaagaatagaaaggttaagggacttggccttctcaggacaaccctttaaatgtacttttccattcctacaaagcctgttgatgctgaaagaaagataggaaatagctcttgtccttgttttgaaggacaggagactaattttcccttcaaacttgatattctggtgtttttgtgactgtttttgtaaattattcaaagttgttggaattttaagtctgattttcccagtactcatcatgaaggtcatagaatatgctctgagttggaaggttttccaaatgggttctcgaccaaaaacccactttttaacaaataattttgatgggttagacatgttcttccatcctctccaaccctgaatatgggcacatacacacaccccttggtacttcctagttctcaaaatgtaatctagcacttcaggcatccaaagtgcccctggttcaatagatagctgcttttttgccagtctctgtgcacaaattgttttaactgaattcagtttaaatttccaaaaaacactgactctgttcaaactagtgttcattggattattgacctgtatgatgccagagttggtcactggcttgactaagttttccattttttttccctaagagatattttgctctcctgcagaacaagcttaataacatcaactttcaaggtagttttggaagatgagaaattgtgcttttgttttggcaactgaaaactttgtccaactgatactatgtgaggaaggtggttcaaggagttttagggccctcttgtccttctttaaggctctgcaaaccttattttggaaaacttatttttctcccttttatttgaatttcctcccagaaattatcatcttggtatcactgagacaaatctaatatcaatttacttgcctgagaaattaggattatgtctgtccacataaatcgcaaggaagaaggtattctgtttatttcctgtccactgactgatgctttcgtatcaccatgtagctgcacatactaaaattataatacaaggaaaaatttattcttttcaaaatcttattcttcaaatactattctgaaagccatttggcaccagtacagaatttaacttaacgccccaatctggaattcactgaacgcattcaaactgttagaaaggaaaataaaaatggaggacaaacacatttttgttctgtttctgaaaacaatatttaaggtcagaactgtttaaaaagaagcactgctaaaaagttataggattcagagaaacatagtatttttgtacagtatcttataaaatgttcagacctctctctacattctctttacaatgtaatgtctctaagtgactggtttcccaataaactgattttaatgcct

SEQ ID NO: 108042 - DNA, 1019 bp, Homo sapiens
  Payload ID: 1227
  Gene Symbol: AAK1
  Gene Name: AP2 associated kinase 1
  ENST ID: ENST00000623317
  CDS Start-End: 1-1019
acccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgatctccagagggagtccaatccctgtcctgtaataactgtagagcactttaaagaatcactgggtgttaaaggccttccgctgtatccagacccctccagagtacctggcacaaagactcagaacaacttagaatctgactacttggccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatggaggagttaacagttatccaatgcacctcccaggagctgcctgcacagaccggtctcctcagtcagacaggtgatgtccccctgcccgcgggccgtgagagagctgtgtacacctctgt

SEQ ID NO: 108043 - DNA, 8964 bp, Homo sapiens
  Payload ID: 1227
  Gene Symbol: AAK1
  Gene Name: AP2 associated kinase 1
  ENST ID: ENST00000606389
  CDS Start-End: 1-1536
acccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgctgaaaaaaggaagggtgggcagactgtggactctggcctcccgcttctaagcgtgtctgatcctttcattcctcttcaagtacctgatgcaccagatctccagagggagtccaatccctgtcctgtaataactgtagagcactttaaagaatcactgggtgttaaaggccttccgctgtatccagacccctccagagtacctggcacaaagactcagaacaacttagaatctgactacttggccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatggaggagttaacagttatccaatgcacctcccaggagctgcctgcacagaccggtctcctcagtcagacaggtgatgtccccctgcccgcgggccgtgagagagctgtgtacacctctgtccaagctcagtattccacagctggttttgtgcaacagtctaacctcctgtcccattctgtacaagcagcagaccatctggacagcatctctcccaggggatcctgcctggaatctgggggtcattctaatgacagaaacaaaggacctcagctccagaaagaagctgtctcaggccccatggctggcaaaccattccgcccccagtccttatccaagtattcccgtcactatagcccagaagacgagccaagtccagaagcccagcccattgctgcctacaaaattgtttcacaaaccaacaagcagtcgatagctgggtctgtttctatcacatccctttcctccaggactacggagctgccagctgctgatccatttgctctagcacccttcccttcaaaatcaggcaagaaaccctaggagcaaaacctgagcctcaagcctcttgtctctatcccaccctcaatacccgccatggcactcccagcttagccttctgaagaagaaatattatcagttcttatatttcaattccctgcgtcagagcagaatttcttgagtcaacaaactcagttgcagtgatatttagttgaagcccctttaagttatgttcatttttgtttgtttgtttgtttgtttatattgatttctggacttggaggcattttcatctccttcacagaggtcatccacttccaccaagaactctgctttccccccgccccacccacagaaactgtttaaatcctgaaatacttcttcaccccaatcccaaaggggccctattgttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggtttgtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgttggaaggtgtagggaaatcctgctggaactggtgtttcagagtaaatcttttttctctccggaatttcttgttttgctattaacaaattatatttacctgattatgaaaaattaattttccttatacattttccccttacaacactagaaaagagcaccttgttacagttccggcctctcagtatgtgggctaaatgccagcattagggaattcattaatcatgagactaggctacaaactaggcttgcttgttttggggtggttttgttgttgttgttgttgttgttgttgttgtttccaaatctctactgccttttgaggaaatgtaaatctgagacatggaaataagtgtttgggagaatggaaaagagctgaatcaggtaggcatgaaaacttttacattctctatcctctttagatgttgaaataggccagacaggttaactgatgttttttaaaattgtcttttatttctggaaagatctgacttattcctagcttttttcataccctttattattagtgccttaaaataaagctggccaggtgcagtgccacacacctgtaataccagcattttggaaggctgaggcaggaggatcagttgagcccaggaagttcaagaccaactctggcaacacagcgagaccctgtcccttcaaaaaataaataaaaaaataggctgggcatggtggctcacacctgtaatcccagcactttgggaggccaaggtgggcagatcacaaggtcaggagtttgagaccagcctggccaacatggtgaaaccccatctctactaaaaatacaaaaaattagctggacgtggtggtgcacacctgtagtcccagctactcaggaggctgaggcaggagaatcgcttgaacccgggaggcagaggttgcagtgagcagagattgcgccactgcactctggcctgggcgacagagcgagtctaaaaaataaaattaaataaaataatgaaaaaaattagctgggtatggtgacatatgcctgtagctactcaggaggctgagctggaaggatcacttgagcccaggagtttgaggctgcagtgagttgtgagtccagcctgggtgacagagtgagacactgtctccaaaaatataataataaaaataaagcctgtatctcaatgggaagatttctgctaaggcagttcaactcactggaaagaactgctgcattaggtttcaactttaatgctttctgttacttctagtaaaggttaagtgatttttccattagctgtagaagtttggagagctatttaccaagccagatcaatgatttaaaaattattggaaattcatctaagaatcaagtctgaatgcccaattctattgcggttgattaggtgtgatattctttaaagttcaggaatattggcagtaaaaaatgagcagctacttttcaatactttgtccttttttggtggtctctgcctatttcaaatgtcctgatcaaaagataaataattggcactgtgccaaggtttggttttccaactaaggtttcaactgtgccagaaacctatgtccttcactttggtggatgctaaatgttattctaagaatatgctttttcccaattctcctttctgatttttatgtattagtggatgcaaaattgtctttctagttgaatgaataatttcggctaatgcacgtggaactttgcaccccagattcttcccatggtcattatcaagtgaagccctcaaaaacatgagcgaagagcctagaaatactcagggagatttctcaccccaactcagaaattttttttttttttttcaagacggcgtcttgctctgtcgctcaggcgggagtgcagtggtgtgatctcggctcactgcaacctccattttccgagttcaagcgattctgcctcagcctcccgagtagctgggattataggcacacaccaccgcgcctggctaatttttgtattcttagtagagatggggtttcaccatgttggccaggttggtcttgaactcttgaccttgtgatccacccaccttggcttcccaaagtgctaggattacaggcgtgagccaccgcacctggcccagaaattctttttttttttttaaattattattatactttaagttttagggtacatgtgcacaatgtgcaggttagttacatatgtatacatgtgccatgctcgtgtgctgcacccactaactcgtcatttagcattaggtatatctcctaatgctatcccgcccccctccccccaccccacaacagtccccagagtgtgatgttccccttactgtgtccatgtgttctctttgttcaattcccacctatgagtgagaacatgcggtgtttggttcagaaattcttaaagtaagagatcattctaattcccctttccaaatattcaggattatctctgtaacagcccagcaaaatgtttttcctttggttatttgataattcccttctaatcaagtgactattttaattctcaaggtgcaaatcaggataaaatcatggtgattttactacatagttgaatacttcgtcaagtatgagcttgtatcctttttaaatttttcactggaggccaggcgcggtggctcacgcttgtaatcccagcactttgggaggccgaggtgggtggatcacttgagggtaggagtttgagaccagcctggccaacatggtgaaaccctgtctctaccaaaaatacaaaaagtagctgggcgtgatggcacgcacctgtagtcccagttactagggaggctgaggcagaattgcttgacccagggaggcagactttgcagtgagccaagattgtgtcattgcactccagcctgggcgagaagagcaaaactccgcctcaaaaaaaaaaaaaaaattgtcactggagacatgatgggtggagactctacataccttctttgaatacagaaacggatgcaaacacatgcaaattacttttttttttttttttggtgatgcatgaaaaaactttgacttgtggattacattaattattagtaacagttagattctgccgacttgtattacagtagggtcttatttccttaaagagaaaaaaaaatacagtcatgccccacttaatgatgagggagacattcagagaaatgcatccttaggtgattttgtcattgtgtgaacatcacagagtgtacttaacacaaacctagatggcacggcctactacctacctaggctatatggtccagcctgttgctcctgggctacaaacctgtacagcatgttactgtactgaatactgtaggcagttgtaacacaatggtaagtatttctgtatccaaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttagaggctcatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgttgtgtgtttggaactgaaattggagaacacgtgccagtcgactgtgaaatggttgctggataaaaccacagatgtggttttatccgagaaatgtgggactgaaattattttgatgagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttggaatcccagcactctgggaggctgtgttgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtga

SEQ ID NO: 108044 - DNA, 728 bp, Homo sapiens
  Payload ID: 1227
  Gene Symbol: AAK1
  Gene Name: AP2 associated kinase 1
  ENST ID: ENST00000624900
  CDS Start-End: 1-300
gctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgtgtaaatgtttcttttctgtgacaccttcattctttacaaatgaaagaaaattacatctagatcccaggaactcatttgctctcgtttgtacaaagggcaagatgacatcattttctataaattttctaactgaactcagactgtttacagattttaaaccttctgattgatcaaaggagaaactaagcaggaaatgtcataatgggttcgggaggatggcacggggctatattaaacatttgtatggtaaaagctgcaaaaatgacagactgtgtctatacattggaggagaaacaggcaaacatttaaaacttcacatggtgcctctttattttcatatgttttcctgtgtataatttacacatgttcatttataaaaatgtggagaaatgaataaggcccaaagtaaagaaaataaaatcttataacccc

SEQ ID NO: 108045 - DNA, 1366 bp, Homo sapiens
  Payload ID: 1228
  Gene Symbol: APIP
  Gene Name: APAF1 interacting protein
  Uniprot ID: Q96GX9
  ENST ID: ENST00000395787
  CDS Start-End: 216-944
acgttggccttgcctcccgggaagtcaggtgcgccgctggatatctcagccggcggggccttaccagaccccggcccccgccccgttcgccccgcccccgggctgccctcagcgccgcctgattgcatttgcggcctcgctgccgtatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacacttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttcctcattgtggaatgagcattctcttgttttaatgttggtgtcagaaaataaatatgaaacattaagtccaaa

SEQ ID NO: 108046 - DNA, 4583 bp, Homo sapiens
  Payload ID: 1228
  Gene Symbol: APIP
  Gene Name: APAF1 interacting protein
  ENST ID: ENST00000532428
  CDS Start-End: 173-760
atgccaccagcactacaaaggcattgatgtagtttggctttctttctatgcagccaaaatccataattaaatcaagcaactggctgtattgcttgatttataaagaacatgcatgattggactgcaaacttttctttgtgcaaaagcaggaaataaataaataccaatttgtatgttttgtgttgccagcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacacttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtccctcccacaacacggaattatgggagctacaagatgagatttgagtggggacacagagccaaaccatatcatccagcgtccaggaagattcaggtcactcagacttgaaggatggggtcagtaaaactctgtggaaacaaaaaggtgtagcagaaagaccactagatgggtgtcaggaaactttgactctaaccccagcaaggccactcgcattttctctgtgattttgtatctcaagtattttaaccatctcttgaaatgttcttgggcctcagcctaggcactatgcctatagaaactaatggataaagcaaccctgcttctttaaaggcctggaggcaagtgcaatcacgtttaatgctgaatatggcaaacttattttccctgttgaagccaagtatctgtgtggaggattagttggatgcatgcttccaaaagaaaccagctgttcttgtaagtaaaggcctgctgaaagaagaaaccaacctatttagcttggagaatatgggggcacagattgccttttcccatcacctgccaggaacaccatgcacttatttcatctcaatgcaagatacaagatctaggatccaaaacactattttctatcacaaagccagttctcacacctttttcagatcaaatgttccagcctcttcagaaaagcttagaaaatagtctttctttcactccccaccagtcttcattgtgacatatgttgcatatcataacccttggtactggatgaaagctcccaatctgaatcaagaacaggtaaaggtaaacaaaaaattgaggctaaaagaatcacttaacctgaaccacatggtaggaaaagcatgctagaatggaatatccaaccggctatggacattgtttttggcagacaaatgaatggccccattataaaggcatcagggttggtgtattgtccaactctagggggcaacattgaattgtatcctatcgttatggtgctccctggagttctgtaaacacataggtctgagagtgattatcacatgcctatcttatccagggaaataaggagcaaaatggcccagaagaagagaaagaacattctaccaagtcacacgtaacctaccaacagtccacaactgcaattgatttcatgcccaactcttgctacacctaagatttgcataacttagtactggggaggttttgggggaaaccagaattccacctctgaagccaagccaaatcttcagtgactggagactgggaaagctgcctttttcaaatttagtttgtctttcccaatagcacttaaaggacaaacgtgttctgttctgcatctttggaactcactattcatggttaagtcattgcctttgagactttataagggctattggcagtttagctttacagtaaatgtagtgtaatttacacaataaaatgcagtcacttgtttaattacttacctcacctattgggactttttctcatctctcaggtcacagtttttacttagggccataacaatggggttgacattggtatgaaacacttttgaaccccccagaatgaagacttcttaactgcacctgaagagtgactcgccaaaaacaatgaaaggtgtttcacaatctgagtgggtgaacttcatctaactgatatgtaaataaaggagtggcgggttaacagctcaatacgcagaagcggcctctcaagaaagcttggctactagaaatgaagggcaacttcactcaaatcctgtgacactgtggaatttaggcacagcaagatgcttgggcctggaccaatggaaggacaaaaggttcctttctctctctgcagttcatccatgtccaaagagagagaacaccaggaggtgggacttctgagttgattctaaatcttcctgtgtaattcaaggcgtgtgtgtgtatctgtgtgtgtgttttctgtttaaaaccaccagagaaatatagatagtccctgagaagaaaagattaatatggcaccttggccttgcccttctggctcacatgagggggatagcccagtagaccagcttggcccaagggagcagaaccgccccagatccaaccacacaaagaaaacagagaccttgaaagaggaaaaataatatttgtggctattaatgaaatcacaatcacaataataattctaatgtcagtagctagcacttgcccacacttaaacatggaaactcagattctggcaaattctgcccactttccaaggctttctgggagtcccaggtgatgttttataggcatttgcacacagccctgttgttttgcactccagcctctgtgttgaagtctgatacctgagagtccctctatgtccttcataataattctggtatcagccagagctgtgtctcttggtagtctcagagccagtaactcaaaaggagccaaactgacatttatcttcctacctgggcatcaaagcattccagatctcatggggtctgctgtgaaaacagctgcttctgcatctctttctctctgggagggtttagacaggagtcaaggagccagactcatccatttgggaattgatatctgcgacagatgattcttttcttttcacctcatccctttccttaccatttactctccctccacccattctgtttcactatatcaggtaaaccccaataatctacactttaatgagcccccttcctggggggagcacagataccacctctgagaagcaaagatgtattcattaaaggctgtatggcctcgtggctgaagctgtgaagtcagacctggatctcaatacaggctctactccttcatactatctccttgagcaagtgacataatctctttgtagcctggtctccttgattaccaaatgaagacagtaacagacttagctcataggattgtggttagaattctacaagatcattcattgattacttccttgtataaataccttattgaggatctgtaatgttccaagtactattctaggtgttagggatacaacatagaacaaaacatacaaaatatctgtcttcatggagcttaagtttcagttagggagatagacaataagcaggaatacaatagaataaaatgttgggcggtgatacagtctataaagcataaatctgattagggatggagagggatggcagggaaagtatttgagaaaagatagtaagatagttaggaaagccctctttgacaaggtggcatatgagcaaagatctgaatgaaaaataattcagcactttgggaggccgaggcgggtggatcatgaggtcaggagttcaagaccagcctgaccaacatggtgaaacccgtctctactgaaaatacaaaaattagccaggcgtggtggtgtgcgcctgtaatcccagctactcatgaggctaagccaggagaatcgcttgaacccaggagtcagaggttgcagtgagccgagatcacgccattgcactccagcctgggtgacaaagcgagactccatctcaaaaaaaaaaaaagaaaaggaaagaaaaagaaaaatacttagcgtatttcaggcatagaatgtttaataaatgggacaatattactttccaggttctcatcttcaagatgctcatagcctatgtacctggaaatgtggcagttgcttgactttattttaaaaaatacatccctaggtcaggtaccgtggctcatgcttgtaattccaacagtttgggaggctgaagtgggaggatcacttgaggccaggagtttgagatcagcctgtctcaaaaaaaaaaaaaaaaa

SEQ ID NO: 108047 - DNA, 8443 bp, Homo sapiens
  Payload ID: 1229
  Gene Symbol: AMER1
  Gene Name: APC membrane recruitment protein 1
  Uniprot ID: Q5JTC6
  ENST ID: ENST00000330258
  CDS Start-End: 274-3681
atgggggagctacccaaagcctggggaaggggagtcagtgctggaggtgactggagccgcggcgacggcggcagcagctgcggtggcggcgctctcagccgtggcagccgaggctgcagcccggcccagggcggctcagcggacaataaccgggctaggaacctgaccgggctggaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcatgtcctgcagctctgactctgactcatctttcactcaaaacctccctgagctgcctcccatggtgacctttgacatcgctgatgtggaacgggatggggaaggcaagtgtgaagagaatcctgagttccacaatgatgaagatcttgcagcctccttggaagcctttgagctgggctactatcacaaacatgccttcaacaactaccatagtcgattctaccaaggcctgccctggggtgtgagcagcctccctcgatacttgggactgcctggcctgcaccctcgacctccacctgctgctatggccctcaacaggagaagccgctctctcgacactgcagagaccctggagatggagctctccaattcccacttggtccagggctacctcgagtctgatgagctgcaggcccagcaggaagattcagatgaggaggacgaagaggaggaagaaggagaatggagccgagacagtcccctttccctctatactgaacccccaggggcctatgattggcctgcttgggctccctgtcctcttccagtggggccaggtcctgcctggataagccccaaccagttggacaggccttccagccagtctccatataggcaggcaacctgttgcatacctcctatgaccatgtcaatatcactatcagtgccagagtcaagggcacctggggaatctgggcctcaactagctcgtccctcacacctacacctgcccatgggcccttgctataacctccagccacaggcctcccagagcatgagggccaggcctcgagatgtgctgctgcctgttgatgagcccagttgctcttccagttctggaggcttcagccccagccctctaccacaggccaagcctgtgggcatcacccatggcattcctcagctgcccagggtccggcctgagcacccccagcctcagcccactcactatgggccttccagccttgacctgtcaaaggagagggctgagcaaggtgcctctcttgccaccagctactcctccactgccatgaatggaaacctagccaagtagttattatcaattctggagtagggacacggggcctgagcatgtgaatggggatcaggggttgggcagaagggtgggggggtgggggttgttgtttaacttgaaaaccctttgggccaaggaaaactcctgtgagttttcaccttggttttcccacttgcctcttctgccatctatggccacgttcaactcaagtgcatctgcccagggaggctgctgctgctactgcactccagtttttgctttcgaggtttcttcttgtgacccacgctgggtttgggatgctgtaattttgtgcctattccagttgccaagttagtgattatatatatatatatatatatatatatatatatatatatatatacacacacacacacacacacacacacacacatacatacacacacacacacaaacacacatgcacacacatatatagcatgcatccttgacacaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcaccagcctccagaccctgctggagaagggccaccagcctatctgggaagagaaaaaggaggtggccaacctttggctaagggctgagagctgccctcaggatcaggaaggcagcatgaggcattgtctctgaggggcactggcatagccctgacacactttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgtttttaatatatatatatatatatatcaaaagtcaattatctatttttatattgtttgcattttatattcatggaaaacaatgtttatcaattgttcttttctgatttatttttaagcggtgctgtttacagttttaaacaaaacaaagatgacacaaaaattgctgctgcttgtgcagagggctggcatctcaactgcctagggccctccctctttcccctctccctaccttagctgtaccacactgtccgttccctccccccatgatagggacagcagaagatgcccaggtactgaagacaaacgccaagtgactcaggcgtgtgggacctggtagacagcttgtcattttctggctttattttatgtttttctttcttttgaacccttcttccccatgtctagaccctctgagagtactcatgtgtcttattttttttcctcgttatgttttgtgctttagttttgaaatcagagtgcccatgttgtgctatttgtcttgttgagtttctccaaaggagcattttgggaacattctccacccaatggggaaggaagggggtttcaaccatgtcccctttccccaagaagctgtgggagacagatgacaatgatgcttgcactatcaggaatttaccatctcgttgaggaaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtca

SEQ ID NO: 108048 - DNA, 3688 bp, Homo sapiens
  Payload ID: 1229
  Gene Symbol: AMER1
  Gene Name: APC membrane recruitment protein 1
  Uniprot ID: Q5JTC6
  ENST ID: ENST00000374869
  CDS Start-End: 274-2688
atgggggagctacccaaagcctggggaaggggagtcagtgctggaggtgactggagccgcggcgacggcggcagcagctgcggtggcggcgctctcagccgtggcagccgaggctgcagcccggcccagggcggctcagcggacaataaccgggctaggaacctgaccgggctggaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctcagcacatgtgcaacccaagcctgcccctgaagccagtagcctagaggagccccatagcccagaaacaggggagaaggtagtagcaggagaggtaaacccacccaatggccctgtgggggacccactgagcctcttgtttggggatgtgacatccctgaaaagctttgattcattgacaggttgtggtgacataatagcagaacaggacatggacagtatgacagacagcatggcctctgggggccagagagcaaaccgagatgggaccaagcgaagttcctgcctggtgacctaccaaggaggtggggaggagatggccttgccagatgatgatgacgaggaggaagaagaggaagaagaggtggaattagaggaggaagaagaggaggttaaggaggaggaagaagatgatgacttagaatatctgtgggaaactgcccaaatgtatccacggcccaatatgaacctgggctaccatcccaccacatccccaggccaccacggctacatgctccttgacccagttaggtcttatcctggcctagcccctggggaacttttgactcctcagagtgaccagcaagaatccgcccccaatagtgatgaaggttattatgactccaccacacctggatttgaggatgattcaggtgaggccctggggcttgtccgcagggattgtctaccccgagacagctacagtggagatgccctatatgagttctatgagccagatgacagccttgagaactctccacctggagatgactgcctttatgacctccatggtcgaagctctgagatgtttgaccccttcttaaactttgagccctttttgtcctcccggccacctggggcaatggagacagaggaagaacggctagtgaccatccagaaacagttgttgtattgggagcttcggcgggagcagcttgaggcccaggaggcacgtgcccgagaagctcatgccagggaggcccacgccagggaggcctatactcgagaggcttatggcagggaagcctatgccagggaggcccacacttgggaagctcatggcagggaggccagaacccgagaagcccaggcccgagaggttcgttgtagagagactcaagtccgagagacccaggcccggcaggagaagcccgtcttagagtatcagatgaggcccttaggcccatcagtgatgggcctggcagcaggggtatcagggacctctcagatttcccaccggggaattacctcagctttccccaccactgcaagcagcgagccagactggagggacttccgtcctctggagaagcgttatgaaggaacctgctccaagaaagatcaaagtacctgcctgatgcagctcttccagagtgatgccatgtttgagccagacatgcaagaagcaaattttggaggatctcccaggagggcctaccctacttattcaccccctgaagatccagaggaagaggaggttgagaaggaagggaatgccactgtgagtttctcacaggccctggtagagttcaccagcaatgggaacctcttttccagcataagatgcccaggtactgaagacaaacgccaagtgactcaggcgtgtgggacctggtagacagcttgtcattttctggctttattttatgtttttctttcttttgaacccttcttccccatgtctagaccctctgagagtactcatgtgtcttattttttttcctcgttatgttttgtgctttagttttgaaatcagagtgcccatgttgtgctatttgtcttgttgagtttctccaaaggagcattttgggaacattctccacccaatggggaaggaagggggtttcaaccatgtcccctttccccaagaagctgtgggagacagatgacaatgatgcttgcactatcaggaatttaccatctcgttgaggaaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtca

SEQ ID NO: 108049 - DNA, 10055 bp, Homo sapiens
  Payload ID: 1230
  Gene Symbol: AMER2
  Gene Name: APC membrane recruitment protein 2
  Uniprot ID: Q8N7J2
  ENST ID: ENST00000357816
  CDS Start-End: 477-2135
aggcaaactccaccccggggagctgttgtgcttgcattgctgggctgctgatagactgattgagtggtggcgtgtacttttgtcacaagaaccataaccacaatgacagccacacagcatggacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattgcgttgtcgtttttagaggcatttcgtgatccatggttgcgctcccgtgaagagcgagtctagagaaggaatccgaagcggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcaggaaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaaccctttgctgtatcactgtgtggaaaatacctccaaagctgaaagagccaggtatttacctgatgagcagaggggaccactgattggcagaaaacttccctacgttcagttgttagatatgcaaattgataaggatctaacactaggaaaataaaggcgagttttggtttggttggtttcagtcatttgtttggggagatataaaaggctcaggagagcaggcttttgcttttgcttttgtttgtttcttcccccacccagtgcagaaatcaggatcagggaaagattttattaaatgccaatagatacagtatttaagcatttataaactgaaaccttttcatgtgaagataatgcatattttaccgtttatccagctgttaacattttgtaatcagtcaattcaatagaattattctggataattctatatctagaatataaaatctggtcttatagctagacatgatgatggtccccaaaccattgatgttctgttatgtactgtaatgggaagcgattctgattttgttttatatgggttctctggttctcaaaaaaaaaaaaaatctattgtgctggtgtcccagaggaatggctctgccttgttttgggtaagagtctgtttctcaccccaaaccctgttttcagatttttttttaccttgattgtaaaatttcagatccaaccattcctcaatataatgagtgcaaaatgaggaacacataaagaaaaacaatagaaagatacagtttttcacatcatttgccttttgctttatagacttatgacaaagacaagtgtgttcagaatatgacactggcaagcttatgtattgtaaacactttatgccaagttttttttgaaaagtggtttgcttctatgtatgttttctaatatttcagatgaaacatttatttcagaaagggttattatatgcctagtttgaatgataaactgaagcagttcctagaatgctattagtgtctaatgatgaaattaatatcctttttgaaatacacttcagtgtatttaatcaaaagaccagagcttctactaggaggtgattcatcataccaggaagattatgcatattcacgtgaaactgcacatatgtaaatgacatgaacacttctgtataagtctcatttccagagagattgcattagtaatgaactgttattacatgctttttaagtttgttttctgtttcataaatgaaagaacaaggcaagttaaatatatgaaaacctattttaataatatgaagaaagtaacaaaataaatggacatcaaaggaaagcaaattgagccagtagcagaaagtaggccattccccattttaaatttgcagtgattcaattaggagaggtttgctgaatttcttcattagtcatatgactggcttttattgcattgtctcagatccataatgttatttcaaagtaatcttttaatatttaatttctttatgtgtgtaaatgaggccctatatgcagtcatagccttaagcattctgaacacactaccaagaattcatataagcatctcacactcacgtgctcatgcactcaactgtgtacagactaacagacaaaagacatctactctagatctggaaattatttttgaaattatttctgtattaaacaagggatttacatttgatttcatgccgctggtactatttaggctcaaaatacattcatcttcccctagtgaatggagaaaatataaattttattcctagctgtaaaacaaaggatcttgatttccttgttgtacattttcctgcaagggttatattctcctttgcatgaatccatggcaaagttatgttggttcatttgttcaattgtacaggaaagttaagaatacctgaaaaacttatgagaatattgtaatagtaaaggcaatctatttcttaagcagtagaagaaaagtttttgctttcataattttaggacttaatcctccatttacaccattatgctgtgtctcctctttataagaaaaggaacacgtgagcaaagtttatcttaatttccactgacctgtcaattaaccagttataaaagatataaaatattttcttttaaaatttatattttccactttttttttaccttattttttaagaattgcacccacaccaatcaaataaaggatttgggcaatgaattaaacagcctcaatcacttgatgggaaatccctggagtggcaggaagagtagattctcaactttttccaaccatagaaaagggatcatagttgctttcttgtgccaagggctactttctctcatttgtgttcatggagattgttttttcaagaattttcctagatttacattccaatttttattaatacattatatctaatgaccttgtgaagattattcaggcccatatttgctgactttttaagggaaggattggatagaggctaattatatctttcccacatgtatgtatattctaagatacttggttgattgacttcctttagttgaaaggctgcccaaattagacaggaaaaagtcaaatcaattgttgggcgaaaatttatcggttggtttaatagctctgcacaaagacagcctgacttgaatgtctatattacacatacactgttatttgaaacactctgctttagtacagatggtggttgatgcgtttatcctgccattagcaccaattgggagaaattttactacagcattttaaataatcacaagagtaaatagatttctattattttatctaataacaacaatagaatatagaatacaaaggacttcctctagatacattttattttatctaataacaacaatggaatatagaatacaaaggacttcctttagatacattttccacaaattatctgcttatttaaatacaaagggtttaatatctatgaaggtaataactcaccgtgtttaaaggatttatttcttcatctcagaggtagtcttcaagtatttgcagttaaacagtatgcaaatagccctttgcttacacaattatccaggtaaaaagactatgtcaggtgttgagatttctttgaattttctaagagttttcattatttacgcctttgtcagattaattttaaaggcaactcttgactgttagcttggtgtgaagagatccactcaggcagctcatgtctcctaagtgccctcagacagcagtgacgggacacttcacatgacgctagcatgttggctctgtccgcatggcggaatgcattccctgctgttagttatctgaatttttctcctgaattacaaatatatggatttggctcccctgatgctgggcttctgctgagacctgttccagtacattcacgtatgctttgctccccttcattgttaagaaattaattcaagaagttttttgctgttaaacataaggaataagcatcacaattgcctcatctcatcactgaggaaagctggtttaaagtatctgagtgaaataagaggaaaaccccaaatacttcacctaacccagtttccctttcccctcctccaggcagagcaaggaaaagaacagttgtaatttgtgtaaactcagccttagaaaatttcaattcattacacacaaaaatatttatgaagcagtttggaaccaaaggggtagtatggtagacgagtgtcttacagagcctgtgtggggaagcaaaaggcaagggtgtagttcacaggcagaagcgagctgtgacattgtcagtgcagcgtgtaagtgtggctcctcacaggcggccattgattgtgagacctcatcttgctctgaagatttcccggtggctgtcatgcattgcttctcaaaagccttgcactgtgataaggtttaaggagacagattgttgcaacaatagccacttctaaggaatgttattatgtcactgcagatgatgtttttaagaggtgattcagaatgatagtttcgtgattacggaaaggagttccttctcaaactgcaaaaggaaagatgaaaatagtcatgaagcctccagaactgaaattgggcaccttttatgatggatatttactttaattcaatgcaacacatatttatggggcatagactgtatcaaatacttaataaaacccattcagtttggagctcacacctaagctgcgctgtaattggattttcttaatattcattaaaaacacaaaacaatattattttacttttttttggtatttgcatttgttgcttatagtttgtggggtgaagcaaagtggtgtgaagttgaagaagggcactatgaattaagccacacaaatgcctctaaaaaatagtaaatgtaacaatggttaacattcattgaatacttactatgtgtcaggcactgctaggagatttagaaataattacttagtcctcttaacagccatgtggggtaggtaatattatctccccagtaagacagctttaattcatcctttttgtttctatccctttccatctctgtctgtctgtctctctctctcttttcccctagtctctaggacagggatataaactctttagtgattttcagtaatagagagctaagcactgcttagtgtcattgtcagctcacttctaatagaaagagctaacccatgtccacgcagctgaaaattagttttgtgtctgagatgatggtgctcacaatcatatacagggaaccctgccactgtgctatgctgagtaggcaaacattggccttcccttggagggatcctcttctcttaggattaatgtgggaagtacagacagaaatctcttctgttgtcatggcgatacttcttccctgacagggtatcattcattcaaagcatatttgtttcatttgtttttattcctaccttaagccatcttggtgggttctgggtggtctatgcatatgtgtgtgtgttttaattgcagtaagaatattgaatatgagatctaccctctttaattttttttttttttttttttgagatggagtcttactctgtcacccaggctggagtgcagtggcttgatctcggctcactataacctccacctcccaggttcaagtgattctcctgcctcagcctcccaagtagctgagactacaggcgtgcaccaccatgcccgttagtttttgtatttttagtagagacagggtttcaccatgttggccaggctggtctcaaactcctgacctcaaatgatctgcccacctctacctccaaagtgttgggattacaggcaatgagccaccacgcccgggttaccttctttaatttttaagtacacaatacagtattgttaactatagccacagtgttgtacagcaaatctctctcacctatgcatcctgcgtaactgaaactctgtgcccattgaacagcagctcctcatttcctcccccatcagcccctggcagccatcattctactctctgcttctgtgagtctggctattttagatcccttatagaagtggaaacgcgcagtatttgtccttctgtgactggcttatttcattgagcataacgacccccaagtttagccatgttgttgcttatggcaggatttccttcttttttcaggctgaataatatttccttatatgtatatgctgcatttttaaaaaccctttcatctactgacagacgtttagattatttccacatcttggctattatgagtaatgctacaacgaacgagggagtgaaaatatctctttaagatcctgatttcagtttttttgaataaatacccagaagtggaatgactgggtcattcatatggtaattctaattaaacatagaattatttttaattttttgagaaacttctgtgctgctttccacagtggttgcatctgtttacatacttaccaatggtgcacaagggttccaatttctccacatctttgccaacttgttatctgtgtttgtttaaatgacagctgtatgagttgtcccttgcctccatgcaattctgaacttcagaaataagcacttggctcctttaatagctgtccgtcctatgttgtgtctacagccactgaatcctgtcctacattttctgattcattaactcattcaactaatagctattgaacaccatcaataagtcagccaccatgaagatgagtattttatattgaattctactaacatatcctgtatgtttactatgttgccagagaggatgctgtgtgctttttttacattgttatctttactcttcacaagaaccatgtaaggtaggtattggtaaaatgggtaattttggaaatgcttcaataatcgagtagaataacttttgctctatgtgagaagatacgttttaaataagatatggcttaggtttctggttacctgagacatactataccttctcagatactctcagacctgaatcatttaacaaactaaggcagaaatactaaaaatatctggttcaataacataggggcatggagtagacatgcagaaaatgcttgttcacttgccttgaaatggctccaggtggcctgaaggaatcaatgaaacttctcaagtatctacattacaaccactggtccccactacacatttatttctaaataaaggaggagaaactctagcaaagtaatatttaacattttcattgcttccaggataaatcttattgaatatggaggatctgatagtggtaggtctatcaggaatatcagggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaaaataacccaaacgagaaactccatttccataattagctttcctgaaagtcaggcatgtctttgaggacaggttttggcagtattatttttgtgcacaggaggaaaattgttagtaggtttatagatgttatttttataatagaatgttaaacccctgaaaaacatcaaaaattgtctcctagaactaattctatgttttaaaaacttgttttaaaaaggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaattacaacactgccattttactgttgtgtttaattcagtcaataaattttgttgctcctttgcatttaaa

SEQ ID NO: 108050 - DNA, 3197 bp, Homo sapiens
  Payload ID: 1230
  Gene Symbol: AMER2
  Gene Name: APC membrane recruitment protein 2
  Uniprot ID: Q8N7J2
  ENST ID: ENST00000515384
  CDS Start-End: 669-2684
ggcaaactccaccccggggagctgttgtgcttgcattgctgggctgctgatagactgattgagtggtggcgtgtacttttgtcacaagaaccataaccacaatgacagccacacagcatggacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattgcgttgtcgtttttagaggcatttcgtgatccatggttgcgctcccgtgaagagcgagtctagagaaggaatccgaaggtgggtgagagttgagggaatttgaattccataattacgactcgaatttctgcaatcagctcgcggctgtgttgcctgctcctgccacaaaaacgccatgcagcgccgagccaagtcggatggaagtgggttagggtattatataagcccttgcgggagggaagatggtcttttatgtgtgtttcttttgcagcggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggaccctcgcggcagacatggacttgcattgtgactgtgccgccgaaacgccggccgccgagccgccgtcggggaagattaataaagctgccttcaaattattcaagaagaggaaatcgggtggcaccatgcccagcatttttggggtcaaaaacaaaggggacgggaaaagctcgggtccgacggggctggtgaggagcaggacccacgacggacttgccgaggtgctggtgctggagagcggcaggaaggaggagccgcgcggcgggggcgacagcggcgggggcggcggggggcggccgaacccggggccccccagagccgcagggcccggcgggggctccctcgccagcagctcggtggccaagtcgcacagcttcttctcgctgctgaagaagaacgggcgctcggaaaacggcaagggagagcctgtggacgcgagcaaggccggcggcaaacaaaagcgggggctgcgggggctgttcagcggcatgcgctggcacaggaaagacaagcgggccaaggcggaggccgcggaggggcgcgcgcccgggggcggcttgatcctacccggctcgctcaccgccagcctggagtgcgtcaaggaggagacgcccagagccgcgcgcgagccggaggagcccagccaggacgccccgcgagacccagcaggtgagcccgcagggggagaggaggtgcccgcccccgccgaccgcgccccagcgcggagctgccgagaggcagagggcctcgcgcaccccggcgacaccggcgcccggggagaggacgccgcggggcatcggcgcgccgagccggggcccggggaggtccgcacggcagaggacgcttccaggacgggggccgttcccgtaaagacggtcccccttgtcgactccgaaggcggcagcggccgggcgcccgccgccccagaccctgcctctgtcgatccaccctcagacccgtcggcagatcgtatttgtttgatgttttctgacgtgacttcactgaaaagctttgactctcttacaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaa

SEQ ID NO: 108051 - DNA, 3273 bp, Homo sapiens
  Payload ID: 1231
  Gene Symbol: AMER3
  Gene Name: APC membrane recruitment protein 3
  Uniprot ID: Q8N944
  ENST ID: ENST00000321420
  CDS Start-End: 260-2845
atcagcctctccccagcaccgactgtgcgctcccgctcccccctcctccccacaaccccgccccacactactggcactgctgcctgagccttcctggagttacttaatccaccccagccccaggcactgaaccacgcgtgcagacccctcgtcctcagttctgcggagacagagtccccacagcatttctgctcctccctcaagactgcggcagagcacagcaccagtagaccccacacacagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgaggggaaaagcctgccctccccaggggacccgtcagaccctggggggcggcgaagcaaagccttcctccccccgggtgaggggccggggctggacggcctgtgccaggacctgttggacagcgagctcctggccgatgcatcctttggtctctgcagggccctgtgtgaggacgtggcctcactccagagcttcgactcgctcacgggttgtggggaggtgttcgcagatgagagctcggtgccatctctggagctgaacgagggcccggagagcccaacccaggctgctcagggcctggagagcaaggttcccaggggccctctccagggcagtgtggagcagctggcctcgcccgcccagaatgaagcctctgacttcaccaggttctgggacagtgtgaatcgctcagtgcgtcagcagcagcgtgccctcctaggcccgtggctttcaggcccccaggggacagacagggaccaatcccggctggacacagctgggctcgctgagctgcccctctgcccctgcagggaccctcgcagcggctccaaagccagctccatcgacacaggcacccccaagagcgagcagcccgaatccgtgtccacaagtgacgagggctactatgattccttctcgccaggacttgaggaggacaagaaggaagctgagagcccaggcactcctgccgccaccttcccacgggacagctacagtggggacgccctctacgagctcttccacgaccccagcgagggtcctcttggccccagcccagatgatgacctgtgcgtgtctgagagtctgtcagggccggccctggggacgccactgtccatatgcagcttccgagtgggggccgaggagaacttggccccagcaccaggccctgacctgctcagccagggcttcctacagagctcctggaagggcaaggagtgcctgctgaagctgtgtgacactgagctcgccatcaccatgggcatcgtcagctggctgcgccgaggccccacgccccgtgccccacccacccctgggcagcctgcagctccacctggttcccagggagcccctagggcacccacagagaagctggggggcagggagggcctggcctcagatgcagggggggcgacagtttgctcagcacccagcaggcaggagctgtgggcacacccgggcaccacaggcctgctcgccggagagagcaaggccctcggaggggccacacaagggactggcacactgtccagggatgcctctcgagaggaagagacacgaggtcactctgaaggcttgttctcctctatggagtctgcagccacttcgacaacagatacttccggtaaaaataaggccccagttccttctacctggccctgctcccagaaggagcctgggccaccaggggtcctggggtgtttccgaggcccctggaggccaggtcacggaggtgacactctggatgcagagcccatgctggcaggctgtgtggcccgtgtggcagccctgaagatcagctcaaacgaacagcccccggccgcatggcctccaaggcaagacatgggcagtgggctctttgggcagcgctgggccaggggccctgacatgctggagcagaaacagtccagcagctcccccagcatgaccaccatccatggcctaccctactcagccagcacacaggaccagaggtgtcgagatcgtgtccaggacctgagctggctcagggtggagcccaccgggctaggtgtccaggcctgggcctctgtggaggaccagcccttgcagctcagcacagaggctgtggagcaggtggcacacggcagccagctggactctgagccccgctcagcccctgctgcccggtggagttcccagggccaccatccagaaagcctgggcctcactttgaacagccagcaggaagggggggtctctgcaagtgccccagaatgccgctgcagcctcctggcccgtgagggcctcctctgtggccagccagaagtgggggcctctgggccagccatggctgagccccatctgtaggacaggctcacatgcaccaggaactgcatgtgtcttcatgaccactttcaggagagcctaggactcaaatctctatcttttgtccctgatgtggggactgtgttgggggtggggggtggcaggactcaggcatgcagagggtagcatgttcatgtggaggcatccttgcctgaacccaccagctcaggcagcccaccgccaaagacagcgcgaagctgcaaccacctagctgctcctcatgcaggggctggagagaggggctagggcttgaaactgagggggagaaagagctgcacattgtaaatgggaagcagagagccaatgagtctgcctgggatgtgtgtgaatcccaaaagacgcaatcccaaatgccatagtcccaagtgttgagaatccaaaatattaaaattactatactctaaaatccg

SEQ ID NO: 108052 - DNA, 651 bp, Homo sapiens
  Payload ID: 1231
  Gene Symbol: AMER3
  Gene Name: APC membrane recruitment protein 3
  ENST ID: ENST00000458606
  CDS Start-End: 111-651
gagctgaccgtggtgctgagcgcggctcgcgctccgacgcggtgcccgagcctgtcgcggccgcgccctgctgcactgcgggcccccagcgcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgagg

SEQ ID NO: 108053 - DNA, 6172 bp, Homo sapiens
  Payload ID: 1231
  Gene Symbol: AMER3
  Gene Name: APC membrane recruitment protein 3
  Uniprot ID: Q8N944
  ENST ID: ENST00000423981
  CDS Start-End: 111-2696
gagctgaccgtggtgctgagcgcggctcgcgctccgacgcggtgcccgagcctgtcgcggccgcgccctgctgcactgcgggcccccagcgcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgtggccaagagcatcccgaggaagaggatttccctgaagaggcccaagaagtgctttcggaacctattccacattcggagaaacaagactgaggacttggcctcgctggcggccgaggggaaaagcctgccctccccaggggacccgtcagaccctggggggcggcgaagcaaagccttcctccccccgggtgaggggccggggctggacggcctgtgccaggacctgttggacagcgagctcctggccgatgcatcctttggtctctgcagggccctgtgtgaggacgtggcctcactccagagcttcgactcgctcacgggttgtggggaggtgttcgcagatgagagctcggtgccatctctggagctgaacgagggcccggagagcccaacccaggctgctcagggcctggagagcaaggttcccaggggccctctccagggcagtgtggagcagctggcctcgcccgcccagaatgaagcctctgacttcaccaggttctgggacagtgtgaatcgctcagtgcgtcagcagcagcgtgccctcctaggcccgtggctttcaggcccccaggggacagacagggaccaatcccggctggacacagctgggctcgctgagctgcccctctgcccctgcagggaccctcgcagcggctccaaagccagctccatcgacacaggcacccccaagagcgagcagcccgaatccgtgtccacaagtgacgagggctactatgattccttctcgccaggacttgaggaggacaagaaggaagctgagagcccaggcactcctgccgccaccttcccacgggacagctacagtggggacgccctctacgagctcttccacgaccccagcgagggtcctcttggccccagcccagatgatgacctgtgcgtgtctgagagtctgtcagggccggccctggggacgccactgtccatatgcagcttccgagtgggggccgaggagaacttggccccagcaccaggccctgacctgctcagccagggcttcctacagagctcctggaagggcaaggagtgcctgctgaagctgtgtgacactgagctcgccatcaccatgggcatcgtcagctggctgcgccgaggccccacgccccgtgccccacccacccctgggcagcctgcagctccacctggttcccagggagcccctagggcacccacagagaagctggggggcagggagggcctggcctcagatgcagggggggcgacagtttgctcagcacccagcaggcaggagctgtgggcacacccgggcaccacaggcctgctcgccggagagagcaaggccctcggaggggccacacaagggactggcacactgtccagggatgcctctcgagaggaagagacacgaggtcactctgaaggcttgttctcctctatggagtctgcagccacttcgacaacagatacttccggtaaaaataaggccccagttccttctacctggccctgctcccagaaggagcctgggccaccaggggtcctggggtgtttccgaggcccctggaggccaggtcacggaggtgacactctggatgcagagcccatgctggcaggctgtgtggcccgtgtggcagccctgaagatcagctcaaacgaacagcccccggccgcatggcctccaaggcaagacatgggcagtgggctctttgggcagcgctgggccaggggccctgacatgctggagcagaaacagtccagcagctcccccagcatgaccaccatccatggcctaccctactcagccagcacacaggaccagaggtgtcgagatcgtgtccaggacctgagctggctcagggtggagcccaccgggctaggtgtccaggcctgggcctctgtggaggaccagcccttgcagctcagcacagaggctgtggagcaggtggcacacggcagccagctggactctgagccccgctcagcccctgctgcccggtggagttcccagggccaccatccagaaagcctgggcctcactttgaacagccagcaggaagggggggtctctgcaagtgccccagaatgccgctgcagcctcctggcccgtgagggcctcctctgtggccagccagaagtgggggcctctgggccagccatggctgagccccatctgtaggacaggctcacatgcaccaggaactgcatgtgtcttcatgaccactttcaggagagcctaggactcaaatctctatcttttgtccctgatgtggggactgtgttgggggtggggggtggcaggactcaggcatgcagagggtagcatgttcatgtggaggcatccttgcctgaacccaccagctcaggcagcccaccgccaaagacagcgcgaagctgcaaccacctagctgctcctcatgcaggggctggagagaggggctagggcttgaaactgagggggagaaagagctgcacattgtaaatgggaagcagagagccaatgagtctgcctgggatgtgtgtgaatcccaaaagacgcaatcccaaatgccatagtcccaagtgttgagaatccaaaatattaaaattactatactctaaaatccgaaaatcacaatcccaaaagatctaaatcctggaaatataattctgggaaaatttttttttaattttttaaaagatacttacattttaaaaggatttatttgagaaacataaaaacacaacagaacacatcagccacttcacacaataaaataggcaataatacatatttttggaagcataaacaggtatacagacagttacaccggtgtgagttattagcagacaaactatattcatgaagaaataggtcaaaatgggaaatgtatacatgcatgtcactatgcttggtaattgtgtgcacctcgctttatacttgcagtcatatcatgaccaacaacctaagtcttttgacgaagtcaatctatgatgcgtcaccaccacacacacagttgcccaaagagcggagatggcaagaactttcatctctcacaattgcagatgtacaaaaattacatctcttcatttattgaggaagttttgacgtttttatacacacgcacaatgcttacacacacagtcaacctgggatgccggcagggtggctcaggacgaaagcctcaggacccaggagggccatgggtgtaagttccagagtccaaaggccagcgagcctgaagctctgatgtcaaggcagtggaagaaaagcctgtcccagctctgagagagagaccagtttgccttctttatttgttctccctgggcctcagcagattgaatgctgcccaccaacattgagggtggatcttccacacctaggcccctcagattcacacactaatctctggaaacacctcacagacatgcccagaataatgatctcccaggtctctaggtatcccttaacccagtcgagttcacacccaaaatgaagtccacaggtccaccccttgtcaacttggcatccatccgcatccccttaaaccattttcagtctccaaataaagccccaagcaaggcagtagctccacctaacatgatgcaactatcccgggattgtgatttttaagactttagatgttagggatttgaaactttagagatttgcgtctttcagtatttcaatgttggggaccagtgtttgggattatgtcttttagaataatgatccaaacttgtgtgaggactgtgaggctcagggtgggagacgggtgggggagccgaccttaggagggcccactgaaccggcctcaatctggccccagtctggcctactcgctgccccaggacaggtggctacaacatgctgagggcctgaagggcgtcccctcaggaacattgtattactgttttgtgttgctataaaggataactgtgaccagatcatttataaagtaaagaagtttatttggcttgtaattctgcaggtgtagaggcatggcaccagcatctgctgctgctttttttttttttttttttttttttgagacagggtctcactttgttgcccaggtgggaatgggagtgcagtggcacagtcttggctcactgcagcctctacctcctgggctcaagcagtcctcccacctcagcctcccaagtagctgggactacaggcgtgcgccaccttgcctggctaatttttctatttttttgtagagacgggttttcgccatgttgcctcagctaaaatgtctcaaaatctcctcaactaaaatgtctcaaaatctcagcctcccacagtgctggatgacaggagtgagccagccagcatcatgcatccctgtgcgccctgccagggctggcgggaccctcccacccttgttgatgggcagtgctagattatttgtcacgaatcatcccctacaaacaatgatttccctccgcttgcactctctaactagagccatggatggccaaatgctttttgggaagaagccaatggattctcctcggctctgcctgcaagtaacaaaggcttttgactccactccctccacgctgtcagatcgccattccccttcaggaaaacttcgaatggggctgtggacctcactccccaaaatgtcacaacacatgtgcagcaccccgacattcagaaccatgaagggagaaggtggctggtgtctgtaggagggacaggtgtccgtcctgggccagtgtcaggccagcaggtgcagggacagatgggccatccacattctccaagattagcttctacctcaaccagcacacctcagcaagatgccaggattgggctccacaggcagccatgaaatgggtttctggaggaaagatcagcacaggaaaaggggtcagtcaggtcgcaggcaaagtgctagggaaatcccatctcatgcagagctcccaccaagaggagcgtgagttgtgctgtcctggctcgagaagaaggcagcacaggatctgtagctgagggtggccctcccaccaggggacgctggtcagtgcctctcctgactgcctgacgcttggtctccggtggccctctctcaccagggctccctgaggcctgctgcaagcaggacacaggctgcacatcacaggttccaaagtgtgcagcaaggcttctgaccaggcccgtccagatctggagcccctgtggagccacatctgagccctcctcccaagactcacacacaggaccacagcagcatcactgagccgagctgggggcaagtttcaccagattcgcttacctgatccttgcatcaacctcaatgcagttgtcagccccatttttcagacctggacacggaggcacagggtgctggtgtgacttgcccacagttattagtgtgtgaggtgatgggttttgtcccgtcccagctccaaaggccctgctcttcctcaagctccagaacctctcactgagctcctgcagtgaagtcccccctcagagccctcagcccttcctgctttcaggctccagatgtcagagcacccttgggtgccagccacaagtggccctccagcaggctgagcacccagggggaggctgccctgactcaaccccagcctggggctttgtgctgcacctgagggagtagccgctctgtaaatccttgttgaaagaatgaagtgtcaaaaggt

SEQ ID NO: 108054 - DNA, 599 bp, Homo sapiens
  Payload ID: 1231
  Gene Symbol: AMER3
  Gene Name: APC membrane recruitment protein 3
  ENST ID: ENST00000431758
  CDS Start-End: 175-599
cacagcaccagtagaccccacacagtgagtacctgtagggcaagtgcctctttcgttctcttaataatagagtcaggtcccttctccaagggaagaccctgccttgcagccccagcctggcctgccccttcttgcaggcccgctccgaaccctggcagctggggcactggcagcatggagctgaagagaggaaagaccttcatcaagtccagcctgcaggtttcccacgagaaacccccagacccagcagccgtggctgcagccagggaggggacaggcccctggtcagtccttccaggagggcaacagaggccccacagtgagaagggcccccaagccagccccagtgcccaagaatacgacagatgccccaacaaaggggcgcagctggaccccaaagggggacccgcagccctctgtggagccaccttcaaaccggtgcgaaagtgcaagactcacgacagcatgtctggggcaggcagggccacggctgccacagggcagctggtgggcagtgcaagcttcccgggctccccgggcagccggcgcatgatcgactaccgccactttgtgccccagatgccctttgtgccagctgt

SEQ ID NO: 108055 - DNA, 3205 bp, Homo sapiens
  Payload ID: 1232
  Gene Symbol: APLN
  Gene Name: apelin
  Uniprot ID: Q9ULZ1
  ENST ID: ENST00000429967
  CDS Start-End: 308-541
cggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaatataa

SEQ ID NO: 108056 - DNA, 1726 bp, Homo sapiens
  Payload ID: 1233
  Gene Symbol: APLNR
  Gene Name: apelin receptor
  Uniprot ID: P35414
  ENST ID: ENST00000257254
  CDS Start-End: 232-1374
ggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaactgttgtgtccaaa

SEQ ID NO: 108057 - DNA, 3609 bp, Homo sapiens
  Payload ID: 1233
  Gene Symbol: APLNR
  Gene Name: apelin receptor
  Uniprot ID: P35414
  ENST ID: ENST00000606794
  CDS Start-End: 198-1340
aggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaacctcctcccaccccccaatccactgcaactctgctgttcacacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccggtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgc

SEQ ID NO: 108058 - DNA, 1789 bp, Homo sapiens
  Payload ID: 1233
  Gene Symbol: APLNR
  Gene Name: apelin receptor
  Uniprot ID: P35414
  ENST ID: ENST00000611099
  CDS Start-End: 311-1453
ggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgc

SEQ ID NO: 108059 - DNA, 674 bp, Homo sapiens
  Payload ID: 1234
  Gene Symbol: APELA
  Gene Name: apelin receptor early endogenous ligand
  Uniprot ID: P0DMC3
  ENST ID: ENST00000510062
  CDS Start-End: 91-255
tgaagacagccacacagatattgcacagactatttacagatcgtttggtttacattgagagtcattgctctacttttgtgcggtaggaaaatgagatttcagcaattcctttttgcattttttatttttattatgagtcttctccttatcagcggacagagaccagttaatttgaccatgagaagaaaactgcgcaaacacaattgccttcagaggagatgtatgcctctccattcacgagtaccctttccctgagatgagatctggctctatcacccaggctaaagtgcagtggcatgatctaggctaactccctggctcaagcgatccttccacctcagcctcccaagtacctgggactacaggcactcacggccacacctgactaatttttgtatttttttgtagagatggagtatcgccatgttgcccagcttcctttgaggaatgaaaatcattgtttgctgtacatttgatcagaagaaaaaagaaaaactgaaattagtgaagtcagtgaagtcttcggtcccgtcctgaatcatttttaccctctgtttagggacaggtctagaacgagtgagcacaaaactgaagagtgtgccgaaaatctcagcaatcaagataacatttgaactccatttttgaaaaaaataaaaactaacacccacgaaaaa

SEQ ID NO: 108060 - DNA, 551 bp, Homo sapiens
  Payload ID: 1234
  Gene Symbol: APELA
  Gene Name: apelin receptor early endogenous ligand
  Uniprot ID: P0DMC3
  ENST ID: ENST00000515275
  CDS Start-End: 139-303
ttcctgcaaaacacagctggcagttctctgaggtttgtcactagaatgtgaagacagccacacagatattgcacagactatttacagatcgtttggtttacattgagagtcattgctctacttttgtgcggtaggaaaatgagatttcagcaattcctttttgcattttttatttttattatgagtcttctccttatcagcggacagagaccagttaatttgaccatgagaagaaaactgcgcaaacacaattgccttcagaggagatgtatgcctctccattcacgagtaccctttccctgaggtatttctgacagaaaatagattcgctacatttaggcagtgttccaaattagatataccaggaaatgtttcttcacagtttgtaatatgtgataatggcttatggcaatgtcaagacttaagagatgcataccaataaatgaaagagttaaatgaatgacatgacttttgagaattgctttaatagttaaggaagaaaattagacagatgaggacaatgtaggaaaatcttgataactgttgaatct

SEQ ID NO: 108061 - DNA, 2602 bp, Homo sapiens
  Payload ID: 1234
  Gene Symbol: APELA
  Gene Name: apelin receptor early endogenous ligand
  Uniprot ID: P0DMC3
  ENST ID: ENST00000507152
  CDS Start-End: 329-493
gcttttggagtacacttccactaaagttatagcatgcttgaatggtttatttcaccaatatttgcttatggaaataaaggggagtggccgaggagaaaggagaagaggagtggaggaggggtttgaggctgagggaggctctgaccacagcacagagcaccggcaactttgtctaatgtgatcattaaccttcctgcaaaacacagctggcagttctctgaggtttgtcactagaatgtgaagacagccacacagatattgcacagactatttacagatcgtttggtttacattgagagtcattgctctacttttgtgcggtaggaaaatgagatttcagcaattcctttttgcattttttatttttattatgagtcttctccttatcagcggacagagaccagttaatttgaccatgagaagaaaactgcgcaaacacaattgccttcagaggagatgtatgcctctccattcacgagtaccctttccctgagatctctctagctaactttactggatctatcagaagaagaagaggagtgaaggaaagacacccagccacacaaaagaacttcatgatgccaacagcgtgattgcttagaagttcctacacaaaaaaaggatcatttgaaagcacctggaatggtttattagcttcacaggattttattcttcttggcttctatttggagggaaaataacataaattcaaaaggattccaatctgaagcccaaatcgtttgcctacataacaaaaatatctcatcttttcctgcacattattattcttttatgggttaaaaagaaaaataccttttagtgttttagaactctctcatggtaaaaagtgcaagaatttaaaatgttgctttcatattcctataattctccaaaagtattaaattcgtatatgtttgagtgattttctaaaaactgctcaacctgaaatcaattgcattgaccatttggcttcgcacaatagggagaaaataattggttcattgattatatagagagaaagactaagaaaagctattaattgctaccaattttatgataagctttaaggtttatgaaagtatgtttttttatttaatgagtaatgtccatttgaagttgaaagaaaacatgaaatcctaattgtagttcattttatgttcaaatgaaaccattgtttttgtttttgttttgaaacagagtctcactctgttgcccaaggtggagagaagtggcacgcttttgtctcactgcaacctccacctcccgagttcaagtgattctcgtgcctcaacctcccaattataggctgggattacaggtgtgcaccactacacccagctaattcttgtattttttgtagagatgaggttttaccctgttgcccaggctggtcttgaactcaggctggaaccattcattttttaacctttctcatcatgtaattataggaacccaacgtttgatttcctttgaagttttgttatgtcctttattattttgtatggataatttctttaaaagtcttacttaaagttgacatctaaaatacagttatgccaatgaagtcccactcagggtgatatctgtatctaaaagatgagtgctcatcatcctattaggctttgtcttggtggtgttcatcctgagatgctgagacatggaaataaaaaatcagaaggaatttagggatatgattactcaaaaaagaaactatcctgtctaaatttgaattgtgttgataactaggtgttccccagatgctaagatgttcttaatttgtatttattgaaggattgttagcttagtgccacaaaatttttcttactttatgttaattccagataagaaatttacaagtttatatctttttttttcttttttttaagatgagatctggctctatcacccaggctaaagtgcagtggcatgatctaggctaactccctggctcaagcgatccttccacctcagcctcccaagtacctgggactacaggcactcacggccacacctgactaatttttgtatttttttgtagagatggagtatcgccatgttgcccaggttggtctcaaactcaggctggtgagctcaagtgatccgcctccttggcctcccaaaatactgggattacaggcatgtgccaccatgctgggccacaagttcatatctggagtagaagttttactttgtaaatattataaagtagaagaaaccataaaccattttgctaaaatgaaaggttggggttaatataaatgtaattttaaatagaaaatctgacaacactgtcgagtttgtcttcctgtcaaagcttattaaaagtgtctttgcggatgaatggtactttccacaagtgcatttgagtagaagcataacctattctcagttatatttatgtttaaaacatgtactggtttgtatattttgtactgaaaaagaaaacactttatagtcaagatacatctcattcaatacaagtctaaactctttcaaatacaaattcgcatattcacagaaaaagttacaaatcagttttactattgtaaagtaatgaaatggttatacatttcttaattgttcaataaaacactcaatgatt

SEQ ID NO: 108062 - DNA, 3245 bp, Homo sapiens
  Payload ID: 1235
  Gene Symbol: APEX2
  Gene Name: APEX nuclease (apurinic/apyrimidinic endonuclease) 2
  Uniprot ID: Q9UBZ4
  ENST ID: ENST00000374987
  CDS Start-End: 67-1623
ctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttcctgtacggctaaggtgaaatcagcaaggaaggtgggctgtgtagccttaaaccagagctttccagctagtgcgtcccacagctgccacagtgggttacagggttgaaagaaacggtcctcagccctcagagttgccaggcagggcctgggaccacacaagtttcagggacgattgcctccttagcaagtagtatcattagtacccctaagtgtgccatggaaatgtttcctgtatactgtgacctggaaagtgggagcattgctttgaacacagtgcttgctctagccaagcctcttctcacctttgaaaatgggactggtagaccaggcacagtggtgcacgcctgtaatcccagcactttgggaggctgagatgggtggatcacctgaggtcaggagttcgcaaccagcctaacatggtgagaccccgtctctactaaatacaaaaaaattaactgggcgtggtggcgcgtgcctgtaatccaagctacttaggaggctgagacaggagaatagcttgtacctgggaggcggaggttgcagtgggctgagatcatgcattgcactccagcctgggcaacaagagtgaaattcagtctccaaaaaaaaaaaaagaaaagaaaaagaatgggactggtaaatcctgttctgtgggatgccgtgggagggagagaggataatggattgaggaagacatccatatccccttatggaaaatacctctttggttttggggaaccactcctttctagggaatttggttagggctgactcatttcctggcttcaggggctaccctgggcccagatttccagggcccggattaccagtgaagcgtcaatccctggatttttattgaaaccattggagaagagccatctcaaataaatctgccaagtatcctagctctttgcaactcactgtgtagtttttgggcatttccttcctctttctcattctgtttccctgttggtaaaatggaatggtgaccaacaagtgacctatggttacctcatagatctgccacttgtctgagggagtcagaatgcacttgtctgttccctgtccaataaaaggcttcacatgc

SEQ ID NO: 108063 - DNA, 1484 bp, Homo sapiens
  Payload ID: 1236
  Gene Symbol: APEX1
  Gene Name: APEX nuclease (multifunctional DNA repair enzyme) 1
  Uniprot ID: P27695
  ENST ID: ENST00000216714
  CDS Start-End: 269-1225
ccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 108064 - DNA, 1387 bp, Homo sapiens
  Payload ID: 1236
  Gene Symbol: APEX1
  Gene Name: APEX nuclease (multifunctional DNA repair enzyme) 1
  Uniprot ID: P27695
  ENST ID: ENST00000398030
  CDS Start-End: 172-1128
cttctttgtgctcgggttaggaggagctaggctgccatcgggccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 108065 - DNA, 451 bp, Homo sapiens
  Payload ID: 1236
  Gene Symbol: APEX1
  Gene Name: APEX nuclease (multifunctional DNA repair enzyme) 1
  ENST ID: ENST00000438886
  CDS Start-End: 1-451
agaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcatagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaa

SEQ ID NO: 108066 - DNA, 568 bp, Homo sapiens
  Payload ID: 1236
  Gene Symbol: APEX1
  Gene Name: APEX nuclease (multifunctional DNA repair enzyme) 1
  ENST ID: ENST00000554325
  CDS Start-End: 237-386
ttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacgagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaag

SEQ ID NO: 108067 - DNA, 640 bp, Homo sapiens
  Payload ID: 1236
  Gene Symbol: APEX1
  Gene Name: APEX nuclease (multifunctional DNA repair enzyme) 1
  ENST ID: ENST00000557592
  CDS Start-End: 124-640
ggagctaggctgccatcgggccggtgcagatacggggttgctcttttgctcataagaggggcttcgctggcagtctgaacggcaagcttgaaagctgcggcgggggtgtttgtcattcccttgatgtacgagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatg

SEQ ID NO: 108068 - DNA, 773 bp, Homo sapiens
  Payload ID: 1236
  Gene Symbol: APEX1
  Gene Name: APEX nuclease (multifunctional DNA repair enzyme) 1
  ENST ID: ENST00000556054
  CDS Start-End: 251-773
aggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatg

SEQ ID NO: 108069 - DNA, 899 bp, Homo sapiens
  Payload ID: 1236
  Gene Symbol: APEX1
  Gene Name: APEX nuclease (multifunctional DNA repair enzyme) 1
  ENST ID: ENST00000553681
  CDS Start-End: 109-899
cccacgtgggggctcagcgtgcacccttctttgtgctcgggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgccta

SEQ ID NO: 108070 - DNA, 304 bp, Homo sapiens
  Payload ID: 1236
  Gene Symbol: APEX1
  Gene Name: APEX nuclease (multifunctional DNA repair enzyme) 1
  ENST ID: ENST00000553368
  CDS Start-End: 180-304
ggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtaggctgcggcgggggtgtttgtcattcccttgatgtacgagccagaggccaagaagagtaagacggccgcaaagaaaaatgacaaagaggcagcaggagagggcccagccctgtatgaggaccccccagatcagaaaacctcacccagtggcaaacc

SEQ ID NO: 108071 - DNA, 1437 bp, Homo sapiens
  Payload ID: 1236
  Gene Symbol: APEX1
  Gene Name: APEX nuclease (multifunctional DNA repair enzyme) 1
  Uniprot ID: P27695
  ENST ID: ENST00000555414
  CDS Start-End: 217-1173
aggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcagcctt

SEQ ID NO: 108072 - DNA, 671 bp, Homo sapiens
  Payload ID: 1236
  Gene Symbol: APEX1
  Gene Name: APEX nuclease (multifunctional DNA repair enzyme) 1
  ENST ID: ENST00000557344
  CDS Start-End: 233-671
cttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcatag

SEQ ID NO: 108073 - DNA, 888 bp, Homo sapiens
  Payload ID: 1236
  Gene Symbol: APEX1
  Gene Name: APEX nuclease (multifunctional DNA repair enzyme) 1
  ENST ID: ENST00000557054
  CDS Start-End: 217-261
aggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcgcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttca

SEQ ID NO: 108074 - DNA, 566 bp, Homo sapiens
  Payload ID: 1236
  Gene Symbol: APEX1
  Gene Name: APEX nuclease (multifunctional DNA repair enzyme) 1
  ENST ID: ENST00000557181
  CDS Start-End: 244-566
ttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaact

SEQ ID NO: 108075 - DNA, 740 bp, Homo sapiens
  Payload ID: 1236
  Gene Symbol: APEX1
  Gene Name: APEX nuclease (multifunctional DNA repair enzyme) 1
  ENST ID: ENST00000557150
  CDS Start-End: 254-740
gggccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacgagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctgg

SEQ ID NO: 108076 - DNA, 952 bp, Homo sapiens
  Payload ID: 1236
  Gene Symbol: APEX1
  Gene Name: APEX nuclease (multifunctional DNA repair enzyme) 1
  ENST ID: ENST00000555839
  CDS Start-End: 225-952
gggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaa

SEQ ID NO: 108077 - DNA, 663 bp, Homo sapiens
  Payload ID: 1237
  Gene Symbol: APH1A
  Gene Name: APH1A gamma secretase subunit
  ENST ID: ENST00000236017
  CDS Start-End: 214-663
ttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaac

SEQ ID NO: 108078 - DNA, 2353 bp, Homo sapiens
  Payload ID: 1237
  Gene Symbol: APH1A
  Gene Name: APH1A gamma secretase subunit
  Uniprot ID: Q96BI3
  ENST ID: ENST00000360244
  CDS Start-End: 494-1237
agcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgt

SEQ ID NO: 108079 - DNA, 1713 bp, Homo sapiens
  Payload ID: 1237
  Gene Symbol: APH1A
  Gene Name: APH1A gamma secretase subunit
  Uniprot ID: Q96BI3
  ENST ID: ENST00000369109
  CDS Start-End: 190-987
aggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 108080 - DNA, 1718 bp, Homo sapiens
  Payload ID: 1237
  Gene Symbol: APH1A
  Gene Name: APH1A gamma secretase subunit
  Uniprot ID: Q96BI3
  ENST ID: ENST00000414276
  CDS Start-End: 400-987
gtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaggtgttccgctttgcctactacaagctgcttaatttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaattgtg

SEQ ID NO: 108081 - DNA, 4189 bp, Homo sapiens
  Payload ID: 1238
  Gene Symbol: APH1B
  Gene Name: APH1B gamma secretase subunit
  Uniprot ID: Q8WW43
  ENST ID: ENST00000261879
  CDS Start-End: 71-844
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggtaggttgggcttctaaatgcaataataaattacgctgactgtggtaacttagccaaagtaagatactgattaagccgtatttttctgaagtgcttccattccaggttttgctttctgaggcattacattgtttttgagtatagattacattttattaactaaaaatgattgttttgtgacttccttgggaaggtattttaaaatcaggaatttttatgcaatgtctataagcctgtttaaagctttccatgggctctgccccaaggccgttggctgcagcgttcaccatctgagtgccagttgctggactagttgaggtgaagtgcattgttttctctctgagcagctgtgcggggagctgagtgatgtgccctgggacaggcttcactggagctggtggaagtataaccagaagcacaaggaaatgagccaaaagggtgtcattgacacttttcatttgctcctgtgatactaacaacactttcacccaaatggcttaatgtaatattggaaatagatcttaaactgccaaatctcacactattgcataatccatatgctctttagatctagtcagtgtctctgggttttggtagcagatacagcgttccctttacaggaatacccaaggtgttctttcagcttccagacaggtcctttgatttcctttataaagggaaaattctggcaaatcgtgcctttactattagaaattgttcccagttgatgtcttttggggagctggtggcatgaaatgcaaatgacctatacattaaagtgatgtctcagtgaataccatacatgcagtagaacattcagaagagaggagcagcaatcctgaggggctgggggagtgacagtggcaggacggatgggcgggtttgacagattgtggtgggaagaagaatgatcatgtttaaagctaacatagccagtgttttgggctagccacacatcattccagagaccaaaaccttactcatgaactagacctttatcgatatcagtgaacccccatgtttaaaatattagaatgtttagagataaaatagagataatagagataaaagaagaggagggcttctatcaatgctgtaaacagtctgataagcgactgtggttattcccctaaagtttacttcagcactaacactagtgcttccgctggagtttgcagttttccagctttatacaggattttcctttgactggaagagtcaaggatatagagactcaacagtgacatttattgtacaacatcaaggggaataggatactcatcaaactgggattattcttatcaaaacatggtcttctttgaataagaaaaatacatagttggttattatggacttaaaactgtgttaaatggatattctgataaaatatttgctgctctgtagagtgtggaaagtctgagaatattagctttactcatcttgagctttgaggatgttctctgtacgccgatggtttcatattaactaaaaaagctgggtattgtaaaatctcatttataaaaactcagatgagaagaaaattttctttgatggtgagactgttgtcttagttcaggaaattatttaataatcctttgttacctgtgaatgaaggaactttgtaattctgatttatcgtaaaacatgagcctttccagagtcagcttagacactgttgtcgcaaatagccatgctttgccttatgccaaggaggcccagagggagggcctagtcttcctctgttgctgtacatatattgaaatgcttttttttttttattttgcatttgttatctataatgagctttctgagccctgatattatgtgagacaaacaggagttattgatgttatacactcccttccattcaggattttctgcttggagggaaatatgttgaccttagagaattgtgaatattgttgcaattcttgaatatattaccatgtgaataatagagactgtgttgctctctagtataagctatatttatttttgattcatttgaattactagttataactggagaaattttgttacctctatcctggcttgcctgactggctgtataatagcagcagcctcttttagagcatcttaatgaaaacatggatgaaaggaattaatgatgatatctgcagactgcgtagaaaatggcttttgttcccagcgttaacattttcttctcaatcacatttcaatgtttgtggagagtggcagattcacaccagaaacactaggtgttcatatccatagcatggatgcagaataagcagttgggagagaagcttcttcctacctggtactcctcccattcacctcagcccagccccagacaggcgttagcattcagtgtgggccctcaggcagccctgaagcctggctgggtcatcagatgggggcagcctgtgacgggcaccagcggcctgattccagggaagagttcctggagggtgttggctgtttttgttagctcagtttttttctgggctccaccattcctaactccaggtagacaagatagatgtcacacacaacaattttaaagtattttgcttagtgcattttgtttatgattgcagtgtttgtttcttatttaataggctttttacttcattctattaaattttagtgtttagaagaggcgggtactgtcactgtgtaaaatatgtaatattttatatgttataccatgtcatatatacttgcaatatcagaccttgcattcaatatacaatgcaattgactctttgcagacctgcatttttcagtgaacaataaaaagattgtctggcactcctca

SEQ ID NO: 108082 - DNA, 872 bp, Homo sapiens
  Payload ID: 1238
  Gene Symbol: APH1B
  Gene Name: APH1B gamma secretase subunit
  ENST ID: ENST00000380340
  CDS Start-End: 15-260
tttccgcggtggccatgactgcggccgtgttcttcggctgcgccttcattgccttcgggcctgcgctcgccctttatgtcttcaccatcgccaccgagccgttgcgtatcatcttcctcatcgccggccgaagggtggaaacctgtaaaaacaccgaagcacctgactgtgcgtctccttctgggagcttgagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 108083 - DNA, 685 bp, Homo sapiens
  Payload ID: 1238
  Gene Symbol: APH1B
  Gene Name: APH1B gamma secretase subunit
  Uniprot ID: Q8WW43
  ENST ID: ENST00000380343
  CDS Start-End: 15-665
tttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 108084 - DNA, 758 bp, Homo sapiens
  Payload ID: 1238
  Gene Symbol: APH1B
  Gene Name: APH1B gamma secretase subunit
  ENST ID: ENST00000560890
  CDS Start-End: 193-758
agtcctgctaattccctgaatcaggccactgccatctcatgcctgcgttgcactgaggacctccagtctggaagctcattttccatatctttacaaagcagatctatcactctgaactgttgtctcgacccgagttttgatagagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgct

SEQ ID NO: 108085 - DNA, 672 bp, Homo sapiens
  Payload ID: 1238
  Gene Symbol: APH1B
  Gene Name: APH1B gamma secretase subunit
  ENST ID: ENST00000560353
  CDS Start-End: 7-672
gtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttc

SEQ ID NO: 108086 - DNA, 1455 bp, Homo sapiens
  Payload ID: 1238
  Gene Symbol: APH1B
  Gene Name: APH1B gamma secretase subunit
  ENST ID: ENST00000559971
  CDS Start-End: 1-60
ctttatgtcttcaccatcgccaccgagccgttgcgtatcatcttcctcatcgccgggtgaggcggtcgcgtcgggaaacccggacgccggggctcccctcccccgctggggttacccgcgaccctcggcgcccccaccgcgcggctcgaccttgttgcgtttcagacgggaggagggttgagagggggagagcggagatccggctccccaaaggcgcctcgccctcttaggaagaagcgcacactggggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcacttggctttcacacaactgctctccgaaaggggtgctcagtggtgtgcgtcctggctgcacgagaatcacctgggacagtgtaaagccgactgattctgggctccaccttccagagctaattggcctgggcacgtggtgagttttaaaagcttcccaggtgattctgatgtgcagccatgttgagacccactggtttggtatccaaataggagcttcctgagaacaccttaagtggatgagaatctggtctttagctgtctcctaactcaactcgtgctgagcaagtaagtatctgaatgtcaaatcctggttatcttttatcttcctaagttctgaagtcacaaaaggctaaagggctatcacccctgctcactgtttgcgtgtacttcaccatcttaggagaacacggta

SEQ ID NO: 108087 - DNA, 1469 bp, Homo sapiens
  Payload ID: 1239
  Gene Symbol: APITD1-CORT
  Gene Name: APITD1-CORT readthrough
  ENST ID: ENST00000400900
  CDS Start-End: 417-911
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaatatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaa

SEQ ID NO: 108088 - DNA, 626 bp, Homo sapiens
  Payload ID: 1239
  Gene Symbol: APITD1-CORT
  Gene Name: APITD1-CORT readthrough
  ENST ID: ENST00000470413
  CDS Start-End: 135-368
gaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 108089 - DNA, 1326 bp, Homo sapiens
  Payload ID: 1239
  Gene Symbol: APITD1-CORT
  Gene Name: APITD1-CORT readthrough
  ENST ID: ENST00000602296
  CDS Start-End: 487-918
gcgggcgccggggtccggcggcgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaaaattttgccaaagaccttgaaatgtttgcaagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaatatca

SEQ ID NO: 108090 - DNA, 571 bp, Homo sapiens
  Payload ID: 1239
  Gene Symbol: APITD1-CORT
  Gene Name: APITD1-CORT readthrough
  ENST ID: ENST00000602787
  CDS Start-End: 84-500
gccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacagcatatgcaggaagcggcaggaataaggaaaagcag

SEQ ID NO: 108091 - DNA, 494 bp, Homo sapiens
  Payload ID: 1239
  Gene Symbol: APITD1-CORT
  Gene Name: APITD1-CORT readthrough
  ENST ID: ENST00000465026
  CDS Start-End: 33-182
ccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 108092 - DNA, 9350 bp, Homo sapiens
  Payload ID: 1240
  Gene Symbol: A1CF
  Gene Name: APOBEC1 complementation factor
  Uniprot ID: Q9NQ94
  ENST ID: ENST00000282641
  CDS Start-End: 282-2042
tttgatatgacgattagagcataacccgagtgacacgttgaattcgccataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaacgttattctgaaatgaaatcaaatgttaaagagccttttgtttaacagaaagctggagagccactgccccaaaagttgttcttccagtcttcctgagtgtttggggagtatgtttacaaatcctgccagggtgaagagagatcttgtagctggcaagatttgggagggatggagcagacctgggcagtcagtaataatcaagggaagccaagtaaactccagagtcttacctctggctcacagctgcttttgtgatacacaaagtcacaaagaggaaaagggaagggaggaggttgcttttcaaaatgcattcaccatggctcactgtgtggggcatgattgcaggcctgagctcatgaaagactgtccaagattttgtggtttcaacctctcttcagcctgaaaattccatccagtcgatttgtcacagatcaggatcttcctgtcccctgcagcccatggggacttcctagaaatagatatgatatgttgtagatgtggttaaaacaaatccaggccccattgtttattcagctcattagtccacacctatttttccctagaactcctaccttttccaataatcatgccagcatgaaatgaccttttctactttaaaattttttgacttgttcatattgcttgattttcatcatctcagactcatttttctcctacctaatatcataaaaaagtaaatcagatatacagaatatcatttatgatacttcttcctttcagcaaattgactgaaaagtcattttaaagagagaagtgcagatttgctctcatttctttgatattgttgcagtatccaccccaccatctagcaatcagagatgcttatattaacttgggattagctttgcattatctaacccatttattttaaatctgccaggaaatcctctaactttccttcctttttgtttcagtaagtatcaggcagcttcaccatacctgagtccttttgtcttgaagctgccacagaaaaatcttacagcaatcattgctgattagaaactgtttcagacaatcagcatgggtgttatttaccaaattccccccagagtcctaggcctcttctccagaaatatctgatgatgaagtgaggggagggcaacggtgctacaaaacacggaacagaggtaaagagaaggcactactttcttgccatacttgtaaatgattgctttgttcaaacataaataatcttaagtccaacaccaaatacctgttactcctacatcaatctcattagtggtttaagacacagtactagaattttcattttttaaaatcccttggcccttaaaaaaatttacagaacacaaaggaaaacataaacacaaagacatggaaaattttgtcaactccttaatggaattctgtgatcaaaaagcaggccagattctaatcaaaatcaggtaaattttaatcacaatcagaagtacttgtaacatttcagttgtcctaactccaatgagataacaaagcctccaaggctacagctgaaactctgaaaggccctgtgctttctactttacatttagcgtctaatatttcctaggacagtagttcccaaagtaggctgtacattagaatctcctggagagctttttaaatgctaatgccaataacatatctcataaaatttacactagaatttccttggatgggtgcctggcatcagtattttttaatgatccctaggtgatttcaatgtgcacctaggtttgggaattgctatattcttgtatttatactctatctctttatttcttttcctttttatttcacttttagtaaatagaaaaatgcaattaaaaaatcatctaagttaagacaaatagccaaatcatatttatcccataaatagtatgaatttaaatgtaacttacgtaggcttcaaactaactctaaaaatgagaaagtaaaacaatcttgtcctaaaacaattcttagatccaaatttacactcccctacagatctgcttttattctcaaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtaggtagaagtggttttggtttttttgctaaaattttactttgttttagtaatatctagggaatactttgaattccattaaaataccttcatagaaagtgttaatgtgtctaccatgccatatgtttatttttactttccccaagttaggtagatagagcaagtcctgctaccataagtttaaaattattaagacaacgggcttttttaaattgctggtagaaccaaaggctaattttgcataggtttatatttttagacttaagaaattagcacctatataataccttcataccttctgcatcactatcaatttttctgtaatttcttatttgaatgcttcctaattctttacagaaaaaattaaaatttgtcacccaaccaggtgataataacaaaacaataatttaggaacatccagtaaatttgaattagttctctaaattttggtaattaatagcttattgataattaaaatcagcctaatgttgcttaagtaggaggaaattgatcagcaatgggattgggtatctattttctttcctataaaagtgctgcctcttctcaaattgctttatttctctcccactgcattagtatatctagaacagcaccttcaactgcaacaaaatataattctcctagatgactaggatatcctccaatctggtatcatgccaaacaacactatgtttggggaacagcacccgaaatgctgctaaaaagctacctcatgtcaagaaaatatggatttcaaaaaatatctggcacagtggcccatgcctataaccccagtactttgggaggccaaggcaggaggattgctggaggccaggagttcaagaccagcctgggcaacatggagagactccgcctctacaaaaaaaaaaaaaacaaatttaatttaattggccagttgtggtggcgtgggcctgtggtcccagctacttgggaagctaaggcaggaggattgctggaggcctggagggcaaggctgcagtgagccatgttcacatcgctgcactccagcctgggtgacagagcaagaccctgtctccaaaaaagcaaaaataaatatctaacaaaaaggaacctgtttccaaaccacagtttcttaactttttcatgatggaatagaaattaaactataagtatatactgataatagctgtgcaggaaattggtttttattttacttaaaagtattttttagaaaaaatgttattctgattgcatagattagcaaaatattgcatcaatataatgttccatttttattaatttttgttatattctaaatgaccgttttataattctgtcttggacaactgggccacagttagaatccacatagacagggaggttcttaggtgtgccatttgtagaataaagggcaatcaagttaatattcggggtaaattttcattgcattctaacctatgaagtttgataaagtatattattattgaacaactctaacactaagatttcctaaaagtaacttacaacaaaaaatgaactatgtgctcaatattcacataaagtcatgattattctcttcttgcattcatataaaagttcccagggggaagaaaatatatctaaaaattagactagaaacttggcactttttatgtattgtagatacactttcatatattgtaaatacatctgttaaagataaaactaagtttctaacatagcactacaaggaaactttggataaatatttttaaaaagaaaatgttaataggataacttaagattttgtatatacttattggaagacaggaagaaactaggcagtaaatattcctacctgacgtgcaaccattgtcaatcaggttttgttaaactgtcaaatttgattttgaaattttagtttgcccaaataatatcttgaaaatgctctgaattttactagaacatattcatagaaagtgtaatgtatctaccaggctctatgtttgtgtttgccaacattagaaaaacaaagtaagttgcgctataatgagtgaaactaaggaaaatgagatttttctgactcccattccctctcttaaaaagtaaaatatttaagctttttttattaaaggaaaaatgggtacagaatactctattgccctccaaatgtccaacatttttaaagccatgttgtccaacaatgtttatacagaaaatagaatgcataggtttaatatagatagcaatgtatatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcacgtcatataaaggttttattatttttaatggaaaataacattgagagattattttcctttttcataaaatttccctttttccctccctctattctcttcactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagacttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaattctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagtttt

SEQ ID NO: 108093 - DNA, 1997 bp, Homo sapiens
  Payload ID: 1240
  Gene Symbol: A1CF
  Gene Name: APOBEC1 complementation factor
  Uniprot ID: Q9NQ94
  ENST ID: ENST00000373993
  CDS Start-End: 46-1830
tgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 108094 - DNA, 2211 bp, Homo sapiens
  Payload ID: 1240
  Gene Symbol: A1CF
  Gene Name: APOBEC1 complementation factor
  Uniprot ID: Q9NQ94
  ENST ID: ENST00000373995
  CDS Start-End: 260-2044
tttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 108095 - DNA, 2116 bp, Homo sapiens
  Payload ID: 1240
  Gene Symbol: A1CF
  Gene Name: APOBEC1 complementation factor
  Uniprot ID: Q9NQ94
  ENST ID: ENST00000373997
  CDS Start-End: 189-1949
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaa

SEQ ID NO: 108096 - DNA, 9221 bp, Homo sapiens
  Payload ID: 1240
  Gene Symbol: A1CF
  Gene Name: APOBEC1 complementation factor
  Uniprot ID: Q9NQ94
  ENST ID: ENST00000374001
  CDS Start-End: 141-1901
tttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaacgttattctgaaatgaaatcaaatgttaaagagccttttgtttaacagaaagctggagagccactgccccaaaagttgttcttccagtcttcctgagtgtttggggagtatgtttacaaatcctgccagggtgaagagagatcttgtagctggcaagatttgggagggatggagcagacctgggcagtcagtaataatcaagggaagccaagtaaactccagagtcttacctctggctcacagctgcttttgtgatacacaaagtcacaaagaggaaaagggaagggaggaggttgcttttcaaaatgcattcaccatggctcactgtgtggggcatgattgcaggcctgagctcatgaaagactgtccaagattttgtggtttcaacctctcttcagcctgaaaattccatccagtcgatttgtcacagatcaggatcttcctgtcccctgcagcccatggggacttcctagaaatagatatgatatgttgtagatgtggttaaaacaaatccaggccccattgtttattcagctcattagtccacacctatttttccctagaactcctaccttttccaataatcatgccagcatgaaatgaccttttctactttaaaattttttgacttgttcatattgcttgattttcatcatctcagactcatttttctcctacctaatatcataaaaaagtaaatcagatatacagaatatcatttatgatacttcttcctttcagcaaattgactgaaaagtcattttaaagagagaagtgcagatttgctctcatttctttgatattgttgcagtatccaccccaccatctagcaatcagagatgcttatattaacttgggattagctttgcattatctaacccatttattttaaatctgccaggaaatcctctaactttccttcctttttgtttcagtaagtatcaggcagcttcaccatacctgagtccttttgtcttgaagctgccacagaaaaatcttacagcaatcattgctgattagaaactgtttcagacaatcagcatgggtgttatttaccaaattccccccagagtcctaggcctcttctccagaaatatctgatgatgaagtgaggggagggcaacggtgctacaaaacacggaacagaggtaaagagaaggcactactttcttgccatacttgtaaatgattgctttgttcaaacataaataatcttaagtccaacaccaaatacctgttactcctacatcaatctcattagtggtttaagacacagtactagaattttcattttttaaaatcccttggcccttaaaaaaatttacagaacacaaaggaaaacataaacacaaagacatggaaaattttgtcaactccttaatggaattctgtgatcaaaaagcaggccagattctaatcaaaatcaggtaaattttaatcacaatcagaagtacttgtaacatttcagttgtcctaactccaatgagataacaaagcctccaaggctacagctgaaactctgaaaggccctgtgctttctactttacatttagcgtctaatatttcctaggacagtagttcccaaagtaggctgtacattagaatctcctggagagctttttaaatgctaatgccaataacatatctcataaaatttacactagaatttccttggatgggtgcctggcatcagtattttttaatgatccctaggtgatttcaatgtgcacctaggtttgggaattgctatattcttgtatttatactctatctctttatttcttttcctttttatttcacttttagtaaatagaaaaatgcaattaaaaaatcatctaagttaagacaaatagccaaatcatatttatcccataaatagtatgaatttaaatgtaacttacgtaggcttcaaactaactctaaaaatgagaaagtaaaacaatcttgtcctaaaacaattcttagatccaaatttacactcccctacagatctgcttttattctcaaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtaggtagaagtggttttggtttttttgctaaaattttactttgttttagtaatatctagggaatactttgaattccattaaaataccttcatagaaagtgttaatgtgtctaccatgccatatgtttatttttactttccccaagttaggtagatagagcaagtcctgctaccataagtttaaaattattaagacaacgggcttttttaaattgctggtagaaccaaaggctaattttgcataggtttatatttttagacttaagaaattagcacctatataataccttcataccttctgcatcactatcaatttttctgtaatttcttatttgaatgcttcctaattctttacagaaaaaattaaaatttgtcacccaaccaggtgataataacaaaacaataatttaggaacatccagtaaatttgaattagttctctaaattttggtaattaatagcttattgataattaaaatcagcctaatgttgcttaagtaggaggaaattgatcagcaatgggattgggtatctattttctttcctataaaagtgctgcctcttctcaaattgctttatttctctcccactgcattagtatatctagaacagcaccttcaactgcaacaaaatataattctcctagatgactaggatatcctccaatctggtatcatgccaaacaacactatgtttggggaacagcacccgaaatgctgctaaaaagctacctcatgtcaagaaaatatggatttcaaaaaatatctggcacagtggcccatgcctataaccccagtactttgggaggccaaggcaggaggattgctggaggccaggagttcaagaccagcctgggcaacatggagagactccgcctctacaaaaaaaaaaaaaacaaatttaatttaattggccagttgtggtggcgtgggcctgtggtcccagctacttgggaagctaaggcaggaggattgctggaggcctggagggcaaggctgcagtgagccatgttcacatcgctgcactccagcctgggtgacagagcaagaccctgtctccaaaaaagcaaaaataaatatctaacaaaaaggaacctgtttccaaaccacagtttcttaactttttcatgatggaatagaaattaaactataagtatatactgataatagctgtgcaggaaattggtttttattttacttaaaagtattttttagaaaaaatgttattctgattgcatagattagcaaaatattgcatcaatataatgttccatttttattaatttttgttatattctaaatgaccgttttataattctgtcttggacaactgggccacagttagaatccacatagacagggaggttcttaggtgtgccatttgtagaataaagggcaatcaagttaatattcggggtaaattttcattgcattctaacctatgaagtttgataaagtatattattattgaacaactctaacactaagatttcctaaaagtaacttacaacaaaaaatgaactatgtgctcaatattcacataaagtcatgattattctcttcttgcattcatataaaagttcccagggggaagaaaatatatctaaaaattagactagaaacttggcactttttatgtattgtagatacactttcatatattgtaaatacatctgttaaagataaaactaagtttctaacatagcactacaaggaaactttggataaatatttttaaaaagaaaatgttaataggataacttaagattttgtatatacttattggaagacaggaagaaactaggcagtaaatattcctacctgacgtgcaaccattgtcaatcaggttttgttaaactgtcaaatttgattttgaaattttagtttgcccaaataatatcttgaaaatgctctgaattttactagaacatattcatagaaagtgtaatgtatctaccaggctctatgtttgtgtttgccaacattagaaaaacaaagtaagttgcgctataatgagtgaaactaaggaaaatgagatttttctgactcccattccctctcttaaaaagtaaaatatttaagctttttttattaaaggaaaaatgggtacagaatactctattgccctccaaatgtccaacatttttaaagccatgttgtccaacaatgtttatacagaaaatagaatgcataggtttaatatagatagcaatgtatatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcacgtcatataaaggttttattatttttaatggaaaataacattgagagattattttcctttttcataaaatttccctttttccctccctctattctcttcactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagacttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaattctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagttttaaaaattatcaa

SEQ ID NO: 108097 - DNA, 9517 bp, Homo sapiens
  Payload ID: 1240
  Gene Symbol: A1CF
  Gene Name: APOBEC1 complementation factor
  ENST ID: ENST00000395489
  CDS Start-End: 401-2209
tttgatatgacgattagagcataacccgagtgacacgttgaattcgccataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaacgttattctgaaatgaaatcaaatgttaaagagccttttgtttaacagaaagctggagagccactgccccaaaagttgttcttccagtcttcctgagtgtttggggagtatgtttacaaatcctgccagggtgaagagagatcttgtagctggcaagatttgggagggatggagcagacctgggcagtcagtaataatcaagggaagccaagtaaactccagagtcttacctctggctcacagctgcttttgtgatacacaaagtcacaaagaggaaaagggaagggaggaggttgcttttcaaaatgcattcaccatggctcactgtgtggggcatgattgcaggcctgagctcatgaaagactgtccaagattttgtggtttcaacctctcttcagcctgaaaattccatccagtcgatttgtcacagatcaggatcttcctgtcccctgcagcccatggggacttcctagaaatagatatgatatgttgtagatgtggttaaaacaaatccaggccccattgtttattcagctcattagtccacacctatttttccctagaactcctaccttttccaataatcatgccagcatgaaatgaccttttctactttaaaattttttgacttgttcatattgcttgattttcatcatctcagactcatttttctcctacctaatatcataaaaaagtaaatcagatatacagaatatcatttatgatacttcttcctttcagcaaattgactgaaaagtcattttaaagagagaagtgcagatttgctctcatttctttgatattgttgcagtatccaccccaccatctagcaatcagagatgcttatattaacttgggattagctttgcattatctaacccatttattttaaatctgccaggaaatcctctaactttccttcctttttgtttcagtaagtatcaggcagcttcaccatacctgagtccttttgtcttgaagctgccacagaaaaatcttacagcaatcattgctgattagaaactgtttcagacaatcagcatgggtgttatttaccaaattccccccagagtcctaggcctcttctccagaaatatctgatgatgaagtgaggggagggcaacggtgctacaaaacacggaacagaggtaaagagaaggcactactttcttgccatacttgtaaatgattgctttgttcaaacataaataatcttaagtccaacaccaaatacctgttactcctacatcaatctcattagtggtttaagacacagtactagaattttcattttttaaaatcccttggcccttaaaaaaatttacagaacacaaaggaaaacataaacacaaagacatggaaaattttgtcaactccttaatggaattctgtgatcaaaaagcaggccagattctaatcaaaatcaggtaaattttaatcacaatcagaagtacttgtaacatttcagttgtcctaactccaatgagataacaaagcctccaaggctacagctgaaactctgaaaggccctgtgctttctactttacatttagcgtctaatatttcctaggacagtagttcccaaagtaggctgtacattagaatctcctggagagctttttaaatgctaatgccaataacatatctcataaaatttacactagaatttccttggatgggtgcctggcatcagtattttttaatgatccctaggtgatttcaatgtgcacctaggtttgggaattgctatattcttgtatttatactctatctctttatttcttttcctttttatttcacttttagtaaatagaaaaatgcaattaaaaaatcatctaagttaagacaaatagccaaatcatatttatcccataaatagtatgaatttaaatgtaacttacgtaggcttcaaactaactctaaaaatgagaaagtaaaacaatcttgtcctaaaacaattcttagatccaaatttacactcccctacagatctgcttttattctcaaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtaggtagaagtggttttggtttttttgctaaaattttactttgttttagtaatatctagggaatactttgaattccattaaaataccttcatagaaagtgttaatgtgtctaccatgccatatgtttatttttactttccccaagttaggtagatagagcaagtcctgctaccataagtttaaaattattaagacaacgggcttttttaaattgctggtagaaccaaaggctaattttgcataggtttatatttttagacttaagaaattagcacctatataataccttcataccttctgcatcactatcaatttttctgtaatttcttatttgaatgcttcctaattctttacagaaaaaattaaaatttgtcacccaaccaggtgataataacaaaacaataatttaggaacatccagtaaatttgaattagttctctaaattttggtaattaatagcttattgataattaaaatcagcctaatgttgcttaagtaggaggaaattgatcagcaatgggattgggtatctattttctttcctataaaagtgctgcctcttctcaaattgctttatttctctcccactgcattagtatatctagaacagcaccttcaactgcaacaaaatataattctcctagatgactaggatatcctccaatctggtatcatgccaaacaacactatgtttggggaacagcacccgaaatgctgctaaaaagctacctcatgtcaagaaaatatggatttcaaaaaatatctggcacagtggcccatgcctataaccccagtactttgggaggccaaggcaggaggattgctggaggccaggagttcaagaccagcctgggcaacatggagagactccgcctctacaaaaaaaaaaaaaacaaatttaatttaattggccagttgtggtggcgtgggcctgtggtcccagctacttgggaagctaaggcaggaggattgctggaggcctggagggcaaggctgcagtgagccatgttcacatcgctgcactccagcctgggtgacagagcaagaccctgtctccaaaaaagcaaaaataaatatctaacaaaaaggaacctgtttccaaaccacagtttcttaactttttcatgatggaatagaaattaaactataagtatatactgataatagctgtgcaggaaattggtttttattttacttaaaagtattttttagaaaaaatgttattctgattgcatagattagcaaaatattgcatcaatataatgttccatttttattaatttttgttatattctaaatgaccgttttataattctgtcttggacaactgggccacagttagaatccacatagacagggaggttcttaggtgtgccatttgtagaataaagggcaatcaagttaatattcggggtaaattttcattgcattctaacctatgaagtttgataaagtatattattattgaacaactctaacactaagatttcctaaaagtaacttacaacaaaaaatgaactatgtgctcaatattcacataaagtcatgattattctcttcttgcattcatataaaagttcccagggggaagaaaatatatctaaaaattagactagaaacttggcactttttatgtattgtagatacactttcatatattgtaaatacatctgttaaagataaaactaagtttctaacatagcactacaaggaaactttggataaatatttttaaaaagaaaatgttaataggataacttaagattttgtatatacttattggaagacaggaagaaactaggcagtaaatattcctacctgacgtgcaaccattgtcaatcaggttttgttaaactgtcaaatttgattttgaaattttagtttgcccaaataatatcttgaaaatgctctgaattttactagaacatattcatagaaagtgtaatgtatctaccaggctctatgtttgtgtttgccaacattagaaaaacaaagtaagttgcgctataatgagtgaaactaaggaaaatgagatttttctgactcccattccctctcttaaaaagtaaaatatttaagctttttttattaaaggaaaaatgggtacagaatactctattgccctccaaatgtccaacatttttaaagccatgttgtccaacaatgtttatacagaaaatagaatgcataggtttaatatagatagcaatgtatatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcacgtcatataaaggttttattatttttaatggaaaataacattgagagattattttcctttttcataaaatttccctttttccctccctctattctcttcactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagacttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaattctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagtttt

SEQ ID NO: 108098 - DNA, 9400 bp, Homo sapiens
  Payload ID: 1240
  Gene Symbol: A1CF
  Gene Name: APOBEC1 complementation factor
  Uniprot ID: Q9NQ94
  ENST ID: ENST00000395495
  CDS Start-End: 308-2092
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaagaacgttattctgaaatgaaatcaaatgttaaagagccttttgtttaacagaaagctggagagccactgccccaaaagttgttcttccagtcttcctgagtgtttggggagtatgtttacaaatcctgccagggtgaagagagatcttgtagctggcaagatttgggagggatggagcagacctgggcagtcagtaataatcaagggaagccaagtaaactccagagtcttacctctggctcacagctgcttttgtgatacacaaagtcacaaagaggaaaagggaagggaggaggttgcttttcaaaatgcattcaccatggctcactgtgtggggcatgattgcaggcctgagctcatgaaagactgtccaagattttgtggtttcaacctctcttcagcctgaaaattccatccagtcgatttgtcacagatcaggatcttcctgtcccctgcagcccatggggacttcctagaaatagatatgatatgttgtagatgtggttaaaacaaatccaggccccattgtttattcagctcattagtccacacctatttttccctagaactcctaccttttccaataatcatgccagcatgaaatgaccttttctactttaaaattttttgacttgttcatattgcttgattttcatcatctcagactcatttttctcctacctaatatcataaaaaagtaaatcagatatacagaatatcatttatgatacttcttcctttcagcaaattgactgaaaagtcattttaaagagagaagtgcagatttgctctcatttctttgatattgttgcagtatccaccccaccatctagcaatcagagatgcttatattaacttgggattagctttgcattatctaacccatttattttaaatctgccaggaaatcctctaactttccttcctttttgtttcagtaagtatcaggcagcttcaccatacctgagtccttttgtcttgaagctgccacagaaaaatcttacagcaatcattgctgattagaaactgtttcagacaatcagcatgggtgttatttaccaaattccccccagagtcctaggcctcttctccagaaatatctgatgatgaagtgaggggagggcaacggtgctacaaaacacggaacagaggtaaagagaaggcactactttcttgccatacttgtaaatgattgctttgttcaaacataaataatcttaagtccaacaccaaatacctgttactcctacatcaatctcattagtggtttaagacacagtactagaattttcattttttaaaatcccttggcccttaaaaaaatttacagaacacaaaggaaaacataaacacaaagacatggaaaattttgtcaactccttaatggaattctgtgatcaaaaagcaggccagattctaatcaaaatcaggtaaattttaatcacaatcagaagtacttgtaacatttcagttgtcctaactccaatgagataacaaagcctccaaggctacagctgaaactctgaaaggccctgtgctttctactttacatttagcgtctaatatttcctaggacagtagttcccaaagtaggctgtacattagaatctcctggagagctttttaaatgctaatgccaataacatatctcataaaatttacactagaatttccttggatgggtgcctggcatcagtattttttaatgatccctaggtgatttcaatgtgcacctaggtttgggaattgctatattcttgtatttatactctatctctttatttcttttcctttttatttcacttttagtaaatagaaaaatgcaattaaaaaatcatctaagttaagacaaatagccaaatcatatttatcccataaatagtatgaatttaaatgtaacttacgtaggcttcaaactaactctaaaaatgagaaagtaaaacaatcttgtcctaaaacaattcttagatccaaatttacactcccctacagatctgcttttattctcaaagacagtgattacattgacataacaaatgtccattggggcaggcaaatttctactgagtctaaaaagcattccaaattctaggagcaaaagttctgattttccttaaaatctttgcaaataaacagcaaagggtattctggatgtcttgtcaatgcaaattaggtttgatttagagaagttttaaatttaatcgcaatgaaaagattagttaatacatgaatctttttatgagaaaaaatcattattctggataaagtcataattgtttgtttacaatattaagagcagacacctaaacatacaataataccaaagtattgagaaaattaccactggaacaccatctcaagttatcacaccatttacctctttagagccagttttgtataagtaggtagaagtggttttggtttttttgctaaaattttactttgttttagtaatatctagggaatactttgaattccattaaaataccttcatagaaagtgttaatgtgtctaccatgccatatgtttatttttactttccccaagttaggtagatagagcaagtcctgctaccataagtttaaaattattaagacaacgggcttttttaaattgctggtagaaccaaaggctaattttgcataggtttatatttttagacttaagaaattagcacctatataataccttcataccttctgcatcactatcaatttttctgtaatttcttatttgaatgcttcctaattctttacagaaaaaattaaaatttgtcacccaaccaggtgataataacaaaacaataatttaggaacatccagtaaatttgaattagttctctaaattttggtaattaatagcttattgataattaaaatcagcctaatgttgcttaagtaggaggaaattgatcagcaatgggattgggtatctattttctttcctataaaagtgctgcctcttctcaaattgctttatttctctcccactgcattagtatatctagaacagcaccttcaactgcaacaaaatataattctcctagatgactaggatatcctccaatctggtatcatgccaaacaacactatgtttggggaacagcacccgaaatgctgctaaaaagctacctcatgtcaagaaaatatggatttcaaaaaatatctggcacagtggcccatgcctataaccccagtactttgggaggccaaggcaggaggattgctggaggccaggagttcaagaccagcctgggcaacatggagagactccgcctctacaaaaaaaaaaaaaacaaatttaatttaattggccagttgtggtggcgtgggcctgtggtcccagctacttgggaagctaaggcaggaggattgctggaggcctggagggcaaggctgcagtgagccatgttcacatcgctgcactccagcctgggtgacagagcaagaccctgtctccaaaaaagcaaaaataaatatctaacaaaaaggaacctgtttccaaaccacagtttcttaactttttcatgatggaatagaaattaaactataagtatatactgataatagctgtgcaggaaattggtttttattttacttaaaagtattttttagaaaaaatgttattctgattgcatagattagcaaaatattgcatcaatataatgttccatttttattaatttttgttatattctaaatgaccgttttataattctgtcttggacaactgggccacagttagaatccacatagacagggaggttcttaggtgtgccatttgtagaataaagggcaatcaagttaatattcggggtaaattttcattgcattctaacctatgaagtttgataaagtatattattattgaacaactctaacactaagatttcctaaaagtaacttacaacaaaaaatgaactatgtgctcaatattcacataaagtcatgattattctcttcttgcattcatataaaagttcccagggggaagaaaatatatctaaaaattagactagaaacttggcactttttatgtattgtagatacactttcatatattgtaaatacatctgttaaagataaaactaagtttctaacatagcactacaaggaaactttggataaatatttttaaaaagaaaatgttaataggataacttaagattttgtatatacttattggaagacaggaagaaactaggcagtaaatattcctacctgacgtgcaaccattgtcaatcaggttttgttaaactgtcaaatttgattttgaaattttagtttgcccaaataatatcttgaaaatgctctgaattttactagaacatattcatagaaagtgtaatgtatctaccaggctctatgtttgtgtttgccaacattagaaaaacaaagtaagttgcgctataatgagtgaaactaaggaaaatgagatttttctgactcccattccctctcttaaaaagtaaaatatttaagctttttttattaaaggaaaaatgggtacagaatactctattgccctccaaatgtccaacatttttaaagccatgttgtccaacaatgtttatacagaaaatagaatgcataggtttaatatagatagcaatgtatatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcacgtcatataaaggttttattatttttaatggaaaataacattgagagattattttcctttttcataaaatttccctttttccctccctctattctcttcactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagacttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaattctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagtttt

SEQ ID NO: 108099 - DNA, 885 bp, Homo sapiens
  Payload ID: 1240
  Gene Symbol: A1CF
  Gene Name: APOBEC1 complementation factor
  ENST ID: ENST00000414883
  CDS Start-End: 282-885
tttgatatgacgattagagcataacccgagtgacacgttgaattcgccataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccag

SEQ ID NO: 108100 - DNA, 727 bp, Homo sapiens
  Payload ID: 1241
  Gene Symbol: APOC4-APOC2
  Gene Name: APOC4-APOC2 readthrough (NMD candidate)
  ENST ID: ENST00000252490
  CDS Start-End: 108-413
gggggttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagc

SEQ ID NO: 108101 - DNA, 1829 bp, Homo sapiens
  Payload ID: 1241
  Gene Symbol: APOC4-APOC2
  Gene Name: APOC4-APOC2 readthrough (NMD candidate)
  ENST ID: ENST00000585685
  CDS Start-End: 41-424
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattctcagagtgagggttccctgtcacttgagagaaggttccctgtgacgtgaccttgggggacgtcattgccctttctgtccccacccaccccctccgcagttctgttggccaggactttggcctagacaaaggatgggggttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagcaa

SEQ ID NO: 108102 - DNA, 680 bp, Homo sapiens
  Payload ID: 1241
  Gene Symbol: APOC4-APOC2
  Gene Name: APOC4-APOC2 readthrough (NMD candidate)
  ENST ID: ENST00000589057
  CDS Start-End: 23-559
cagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaatt

SEQ ID NO: 108103 - DNA, 1227 bp, Homo sapiens
  Payload ID: 1242
  Gene Symbol: APOA1
  Gene Name: apolipoprotein A-I
  Uniprot ID: P02647
  ENST ID: ENST00000236850
  CDS Start-End: 367-1170
cacaatggacaatggcaactgcccacacactcccatggaggggaaggggatgagtgcagggaaccccgaccccacccgggagacctgcaagcctgcagacactcccctcccgcccccactgaacccttgacccctgccctgcagcccccgcagcttgctgtttgcccactctatttgcccagccccagggacagagctgatccttgaactcttaagttccacattgccaggaccagtgagcagcaacagggccggggctgggcttatcagcctcccagcccagaccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaa

SEQ ID NO: 108104 - DNA, 932 bp, Homo sapiens
  Payload ID: 1242
  Gene Symbol: APOA1
  Gene Name: apolipoprotein A-I
  Uniprot ID: P02647
  ENST ID: ENST00000359492
  CDS Start-End: 72-875
aggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaa

SEQ ID NO: 108105 - DNA, 940 bp, Homo sapiens
  Payload ID: 1242
  Gene Symbol: APOA1
  Gene Name: apolipoprotein A-I
  Uniprot ID: P02647
  ENST ID: ENST00000375320
  CDS Start-End: 80-883
cccggtcactctggctccccagctcaaggttcaggccttgccccaggccgggcctctgggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaa

SEQ ID NO: 108106 - DNA, 1088 bp, Homo sapiens
  Payload ID: 1242
  Gene Symbol: APOA1
  Gene Name: apolipoprotein A-I
  Uniprot ID: P02647
  ENST ID: ENST00000375323
  CDS Start-End: 228-1031
cgagaaggaggtgcgtcctgctgcctgccccggtcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaa

SEQ ID NO: 108107 - DNA, 927 bp, Homo sapiens
  Payload ID: 1242
  Gene Symbol: APOA1
  Gene Name: apolipoprotein A-I
  ENST ID: ENST00000375329
  CDS Start-End: 133-870
aaggaggtgcgtcctgctgcctgccccggtcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacggcctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaa

SEQ ID NO: 108108 - DNA, 1012 bp, Homo sapiens
  Payload ID: 1243
  Gene Symbol: APOA1BP
  Gene Name: apolipoprotein A-I binding protein
  ENST ID: ENST00000368233
  CDS Start-End: 28-765
gccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggtgctgggatccagaaggtggggtgggggagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctctt

SEQ ID NO: 108109 - DNA, 901 bp, Homo sapiens
  Payload ID: 1243
  Gene Symbol: APOA1BP
  Gene Name: apolipoprotein A-I binding protein
  ENST ID: ENST00000368234
  CDS Start-End: 44-826
gccggggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctct

SEQ ID NO: 108110 - DNA, 1125 bp, Homo sapiens
  Payload ID: 1243
  Gene Symbol: APOA1BP
  Gene Name: apolipoprotein A-I binding protein
  Uniprot ID: Q8NCW5
  ENST ID: ENST00000368235
  CDS Start-End: 44-910
gccggggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgccaa

SEQ ID NO: 108111 - DNA, 474 bp, Homo sapiens
  Payload ID: 1244
  Gene Symbol: APOA2
  Gene Name: apolipoprotein A-II
  Uniprot ID: P02652
  ENST ID: ENST00000367990
  CDS Start-End: 59-361
aggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 108112 - DNA, 265 bp, Homo sapiens
  Payload ID: 1244
  Gene Symbol: APOA2
  Gene Name: apolipoprotein A-II
  ENST ID: ENST00000469730
  CDS Start-End: 66-265
aaagaggcctgggcttcagttgtggagagggagagagccaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaa

SEQ ID NO: 108113 - DNA, 421 bp, Homo sapiens
  Payload ID: 1244
  Gene Symbol: APOA2
  Gene Name: apolipoprotein A-II
  ENST ID: ENST00000468465
  CDS Start-End: 150-308
ggcaggcacagacaccaaggacagagacgctggctaggccgccctccccactgttaccaacatgaagctgctcgcagcaactgtgctactcctcaccatctgcagccttgaagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 108114 - DNA, 469 bp, Homo sapiens
  Payload ID: 1244
  Gene Symbol: APOA2
  Gene Name: apolipoprotein A-II
  ENST ID: ENST00000463273
  CDS Start-End: 185-469
ggaggcaagatgtgtgagcagcatccaaagaggcctgggcttcagttgtggagagggagagagccaggttggaatgggcagcaggtagggagatccctggggaggagctgaagcccatttggcttcagtgtcccccaaacccccaccaccctcttcctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaaca

SEQ ID NO: 108115 - DNA, 401 bp, Homo sapiens
  Payload ID: 1244
  Gene Symbol: APOA2
  Gene Name: apolipoprotein A-II
  ENST ID: ENST00000463812
  CDS Start-End: 130-288
ggcaggcacagacaccaaggacagagacgctggctaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 108116 - DNA, 530 bp, Homo sapiens
  Payload ID: 1244
  Gene Symbol: APOA2
  Gene Name: apolipoprotein A-II
  ENST ID: ENST00000464492
  CDS Start-End: 40-441
aaggacagagacgctggctaggtaagataaggaggcaagatgtgtgagcagcatccaaagaggcctgggcttcagttgtggagagggagagagccaggttggaatgggcagcaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgc

SEQ ID NO: 108117 - DNA, 416 bp, Homo sapiens
  Payload ID: 1244
  Gene Symbol: APOA2
  Gene Name: apolipoprotein A-II
  ENST ID: ENST00000470459
  CDS Start-End: 59-307
aggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaa

SEQ ID NO: 108118 - DNA, 655 bp, Homo sapiens
  Payload ID: 1244
  Gene Symbol: APOA2
  Gene Name: apolipoprotein A-II
  ENST ID: ENST00000481511
  CDS Start-End: 25-243
gccgccctccccactgttaccaacatgaagctgctcgcagcaactgtgctactcctcaccatctgcagccttgaaggtctggcaaccaaagggctcaaaaggaagatcattccctctctaaagcccagaaagcccatccaaagatctggctggatacctttttggggagggggcagagagctggggtgggtactggcagaggtatggcaggaggccaggattcactgctgtggacccagctgaaaagagtgtgtgtgtgtgtgtgtgtgtgtgtgtgtgtgtgtgtgggcaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcc

SEQ ID NO: 108119 - DNA, 263 bp, Homo sapiens
  Payload ID: 1244
  Gene Symbol: APOA2
  Gene Name: apolipoprotein A-II
  ENST ID: ENST00000491350
  CDS Start-End: 8-91
taccaacatgaagctgctcgcagcaactgtgctactcctcaccatctgcagccttgaaggtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctt

SEQ ID NO: 108120 - DNA, 1473 bp, Homo sapiens
  Payload ID: 1245
  Gene Symbol: APOA4
  Gene Name: apolipoprotein A-IV
  Uniprot ID: P06727
  ENST ID: ENST00000357780
  CDS Start-End: 116-1306
tcagttcccactgcagcgcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacggtgatgtgggactacttcagccagctgagcaacaatgccaaggaggccgtggaacatctccagaaatctgaactcacccagcaactcaatgccctcttccaggacaaacttggagaagtgaacacttacgcaggtgacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcagcacgcaggccgagcagctgcggcgccagctgaccccctacgcacagcgcatggagagagtgctgcgggagaacgccgacagcctgcaggcctcgctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccgaggagctcaaggccaggatctcggccagtgccgaggagctgcggcagaggctggcgcccttggccgaggacgtgcgtggcaacctgaggggcaacaccgaggggctgcagaagtcactggcagagctgggtgggcacctggaccagcaggtggaggagttccgacgccgggtggagccctacggggaaaacttcaacaaagccctggtgcagcagatggaacagctcaggcagaaactgggcccccatgcgggggacgtggaaggccacttgagcttcctggagaaggacctgagggacaaggtcaactccttcttcagcaccttcaaggagaaagagagccaggacaagactctctccctccctgagctggagcaacagcaggaacagcagcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctcaa

SEQ ID NO: 108121 - DNA, 1897 bp, Homo sapiens
  Payload ID: 1246
  Gene Symbol: APOA5
  Gene Name: apolipoprotein A-V
  Uniprot ID: Q6Q788
  ENST ID: ENST00000227665
  CDS Start-End: 36-1136
caggcctccctccacctgtcttctcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaa

SEQ ID NO: 108122 - DNA, 526 bp, Homo sapiens
  Payload ID: 1246
  Gene Symbol: APOA5
  Gene Name: apolipoprotein A-V
  ENST ID: ENST00000433069
  CDS Start-End: 41-526
aatgtctgctctctgtgcccagacgtgagcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttg

SEQ ID NO: 108123 - DNA, 1929 bp, Homo sapiens
  Payload ID: 1246
  Gene Symbol: APOA5
  Gene Name: apolipoprotein A-V
  Uniprot ID: Q6Q788
  ENST ID: ENST00000542499
  CDS Start-End: 74-1174
ataaagcagaatgtctgctctctgtgcccagacgtgagcaggcctccctccacctgtcttctcagagcaggtaatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatg

SEQ ID NO: 108124 - DNA, 14121 bp, Homo sapiens
  Payload ID: 1247
  Gene Symbol: APOB
  Gene Name: apolipoprotein B
  Uniprot ID: P04114
  ENST ID: ENST00000233242
  CDS Start-End: 129-13820
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgacattcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagaccctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 108125 - DNA, 3128 bp, Homo sapiens
  Payload ID: 1247
  Gene Symbol: APOB
  Gene Name: apolipoprotein B
  ENST ID: ENST00000399256
  CDS Start-End: 18-2504
ccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatggatcgcccagactcccttacgatcccagctgcacaagcccgaaaagatgcttgtactttcttcagagatggaggtttgccttgaatttcactgaagatgactcttggatcacatggaaatgttaacatttagaaattaagctattcataatgttagctgtatttttaagagcattaatttattcatctggaaaacaatgttcggtataccttcctctacctttgctgaaggtccttttatttttatttttatttttttaattttttgagatggagtcttgctcccaggctggagtgcagtgatacaatctcggctcactgcaactctgccttccgggttcaagcaattctcctgcctcagcctcccaagtagctgggactgtggacgtgcaccagcatgcccggctaatttgtgtatctttagtagagacaagcctgttgacaaccatgtcaggctggtttcgaactcctgacctcaagtgatcctccagcctgggcctcccacagtgctggaataacaggtgtgagccactgcacctgacctgaaggtccttttaagattgaaatgatacaatgattataaaagaaagtatttggcaaactataattcactatctaaatatgctataatttttattattaattcataaaaggaaatatataaatgtactcctatggcttgattaaaaaaatgttgactttaagaaaa

SEQ ID NO: 108126 - DNA, 13991 bp, Homo sapiens
  Payload ID: 1247
  Gene Symbol: APOB
  Gene Name: apolipoprotein B
  ENST ID: ENST00000616098
  CDS Start-End: 1-13035
atggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgacattcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagaccctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccagatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaacaaccacaaaagcccaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 108127 - DNA, 879 bp, Homo sapiens
  Payload ID: 1248
  Gene Symbol: APOBEC1
  Gene Name: apolipoprotein B mRNA editing enzyme, catalytic polypeptide 1
  Uniprot ID: P41238
  ENST ID: ENST00000229304
  CDS Start-End: 22-732
gaagtccagagacagagcaccatgacttctgagaaaggtccttcaaccggtgaccccactctgaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatgagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggca

SEQ ID NO: 108128 - DNA, 861 bp, Homo sapiens
  Payload ID: 1248
  Gene Symbol: APOBEC1
  Gene Name: apolipoprotein B mRNA editing enzyme, catalytic polypeptide 1
  ENST ID: ENST00000467171
  CDS Start-End: 32-142
tccagaggaggaagtccagagacagagcaccatgacttctgagaaaggagaagaatcgaaccctgggagtttgacgtcttctatgaccccagagaacttcgtaaagaggcctgtctgctctacgaaatcaagtggggcatgagccggaagatctggcgaagctcaggcaaaaacaccaccaatcacgtggaagttaattttataaaaaaatttacgtcagaaagagattttcacccatccatgagctgctccatcacctggttcttgtcctggagtccctgctgggaatgctcccaggctattagagagtttctgagtcggcaccctggtgtgactctagtgatctacgtagctcggcttttttggcacatggatcaacaaaatcggcaaggtctcagggaccttgttaacagtggagtaactattcagattatgagagcatcagagtattatcactgctggaggaattttgtcaactacccacctggggatgaagctcactggccacaatacccacctctgtggatgatgttgtacgcactggagctgcactgcataattctaagtcttccaccctgtttaaagatttcaagaagatggcaaaatcatcttacatttttcagacttcatcttcaaaactgccattaccaaacgattccgccacacatccttttagctacagggctgatacatccttctgtggcttggagatgaataggatgattccgtgtgtgtactgattcaagaacaagcaatgatgacccactaaagagtgaatgccatttagaatctagaaatgttcacaaggtaccccaaaactctgtagcttaaaccaacaataaatatgtattacctctggca

SEQ ID NO: 108129 - DNA, 1151 bp, Homo sapiens
  Payload ID: 1249
  Gene Symbol: APOBEC2
  Gene Name: apolipoprotein B mRNA editing enzyme, catalytic polypeptide-like 2
  Uniprot ID: Q9Y235
  ENST ID: ENST00000244669
  CDS Start-End: 45-719
gcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtg

SEQ ID NO: 108130 - DNA, 1444 bp, Homo sapiens
  Payload ID: 1250
  Gene Symbol: APOBEC3A
  Gene Name: apolipoprotein B mRNA editing enzyme, catalytic polypeptide-like 3A
  Uniprot ID: P31941
  ENST ID: ENST00000249116
  CDS Start-End: 171-770
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 108131 - DNA, 1478 bp, Homo sapiens
  Payload ID: 1250
  Gene Symbol: APOBEC3A
  Gene Name: apolipoprotein B mRNA editing enzyme, catalytic polypeptide-like 3A
  Uniprot ID: P31941
  ENST ID: ENST00000402255
  CDS Start-End: 205-804
ggcctccctgccacggggatgctgccttttctgctccgggtgtttccacgaggcaggcatggaatcttccctggacaagcgacataccgtggagagacaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 108132 - DNA, 1103 bp, Homo sapiens
  Payload ID: 1250
  Gene Symbol: APOBEC3A
  Gene Name: apolipoprotein B mRNA editing enzyme, catalytic polypeptide-like 3A
  Uniprot ID: P31941
  ENST ID: ENST00000570508
  CDS Start-End: 171-770
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacact

SEQ ID NO: 108133 - DNA, 1103 bp, Homo sapiens; identical to SEQ ID NO: 108132
  Payload ID: 1250
  Gene Symbol: APOBEC3A
  Gene Name: apolipoprotein B mRNA editing enzyme, catalytic polypeptide-like 3A
  Uniprot ID: P31941
  ENST ID: ENST00000618553
  CDS Start-End: 171-770

SEQ ID NO: 108134 - DNA, 1135 bp, Homo sapiens
  Payload ID: 1250
  Gene Symbol: APOBEC3A
  Gene Name: apolipoprotein B mRNA editing enzyme, catalytic polypeptide-like 3A
  Uniprot ID: P31941
  ENST ID: ENST00000623492
  CDS Start-End: 205-804
ggcctccctgccacggggatgctgccttttctgctccgggtgtttccacgaggcaggcatggaatcttccctggacaagcgacataccgtggagagacaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaaca

SEQ ID NO: 108135 - DNA, 1533 bp, Homo sapiens
  Payload ID: 1251
  Gene Symbol: APOBEC3B
  Gene Name: apolipoprotein B mRNA editing enzyme, catalytic polypeptide-like 3B
  Uniprot ID: Q9UH17
  ENST ID: ENST00000333467
  CDS Start-End: 46-1194
caaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactagcaaa

SEQ ID NO: 108136 - DNA, 1359 bp, Homo sapiens
  Payload ID: 1251
  Gene Symbol: APOBEC3B
  Gene Name: apolipoprotein B mRNA editing enzyme, catalytic polypeptide-like 3B
  Uniprot ID: Q9UH17
  ENST ID: ENST00000335760
  CDS Start-End: 49-804
cttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataa

SEQ ID NO: 108137 - DNA, 1844 bp, Homo sapiens
  Payload ID: 1251
  Gene Symbol: APOBEC3B
  Gene Name: apolipoprotein B mRNA editing enzyme, catalytic polypeptide-like 3B
  ENST ID: ENST00000402182
  CDS Start-End: 56-1528
cacagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactagcaaatgtgtagatgtctttccttg

SEQ ID NO: 108138 - DNA, 1282 bp, Homo sapiens
  Payload ID: 1251
  Gene Symbol: APOBEC3B
  Gene Name: apolipoprotein B mRNA editing enzyme, catalytic polypeptide-like 3B
  Uniprot ID: Q9UH17
  ENST ID: ENST00000407298
  CDS Start-End: 108-1181
actttaaggagggctgtccaactgcaaggacgctgtaagcaggaagtgaaaccacagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctc

SEQ ID NO: 108139 - DNA, 2818 bp, Homo sapiens
  Payload ID: 1252
  Gene Symbol: APOBEC3C
  Gene Name: apolipoprotein B mRNA editing enzyme, catalytic polypeptide-like 3C
  Uniprot ID: Q9NRW3
  ENST ID: ENST00000361441
  CDS Start-End: 281-853
agataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaaaaaaaaaaaaaaaaaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatcttttttttttttttttttttttttgagacagagtgttgctcctcttgtccaggctggaatgcaatggcacaatctggactcactgcaacctccgcctcccgagtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcagcctctccaagtgctgggattacaggcatcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 108140 - DNA, 1056 bp, Homo sapiens
  Payload ID: 1252
  Gene Symbol: APOBEC3C
  Gene Name: apolipoprotein B mRNA editing enzyme, catalytic polypeptide-like 3C
  ENST ID: ENST00000428892
  CDS Start-End: 102-287
aaagagggctgctcaactgcaaggacgctgtaagcaggaagagaagccacagcgcttcagaaaagagtgggacagggacaagcatatctaagaggctgaacatgaatccacagatcaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaaaaaaaaaaaaaaaaaaaagccagatgtggtggcatgcatctgtagtccaagctacttgggaggctgaagtgggaggattacttgagcccgagaggtgga

SEQ ID NO: 108141 - DNA, 2528 bp, Homo sapiens
  Payload ID: 1253
  Gene Symbol: APOBEC3D
  Gene Name: apolipoprotein B mRNA editing enzyme, catalytic polypeptide-like 3D
  Uniprot ID: Q96AK3
  ENST ID: ENST00000216099
  CDS Start-End: 408-1568
tttttttttttttgagaggaagcctcgctctctcacccaggctggagtgcagtggcaggaacttggctcactgcaacctccgcttcccaggttcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaaagtgctgggattacaggcgtgagccaccgtgcccggccgggaggtcactttaaggagggctgtccaactgcaaggagccgcaagcaggaagtgaaaccacagcacttcaaaaaaagagggagactgggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggcccggtactacccaaacgtcagtcgaatcacaggcaggaggtgtatttccggtttgagaaccacgcagaaatgtgcttcttatcttggttctgtggcaaccgactgcctgctaacaggcgcttccagatcacctggtttgtatcatggaacccctgcctgccctgtgtggtgaaggtgaccaaattcttggctgagcaccccaatgtcaccctgaccatctctgccgcccgcctctactactaccgggatagagattggcggtgggtgctcctcaggctgcataaggcaggggcccgtgtgaagatcatggactatgaagactttgcatactgctgggaaaactttgtgtgcaatgaaggtcagccattcatgccttggtacaaattcgatgacaattatgcatccctgcaccgcacgctaaaggagattctcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtgaggggtctccctgggcctcatggtctgtctcttctagcctcctgctcatgctgcacgggcctcccctccatcctgcaccagctgtgcttttgcctggtcatcctgagcccctcctggcctcagggccattccatagtgcccccctgcctcaccacctcctccccgctctcccaggctcttcttgtagaggctctccatccacctccccagtcctgttcccccagcctgggtgcccctaacttgactcttcccatctccccagcataaccaaatcttttttttttttttttttttttgagacggagtttcactctgtcgcccagactagagtgcaatggctggatctcagctcactgcaaactctgcttactgggttcaagtgattctcctgtctcagcttctgagtagctgggattacagatgcctgccaccacgcccagctaatttttttttttttttttttttttttttgtatttttagtagtgactgggtttcaccatgttggccaggctggtcttgaactcctgacctcaggtgatctgcccatctctgtctcccaaagtgctgggattacgggcgtgagccacccggctcggccgcacaaccaaatcttattaaactcaatctagtctggccctggtgactcacgcctttcggaggcagaggtgggagaatcgcttgagcccagaagtttgagaccagcctgggccacacgacaaagccccatttctacaaaaaaaaataccaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcaagaccctgcctgaaaataaatcaataaatacactcaacctaaatggatatgaatatatgtaagttgaaaacc

SEQ ID NO: 108142 - DNA, 1161 bp, Homo sapiens
  Payload ID: 1253
  Gene Symbol: APOBEC3D
  Gene Name: apolipoprotein B mRNA editing enzyme, catalytic polypeptide-like 3D
  Uniprot ID: Q96AK3
  ENST ID: ENST00000381568
  CDS Start-End: 1-1161
atgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggcccggtactacccaaacgtcagtcgaatcacaggcaggaggtgtatttccggtttgagaaccacgcagaaatgtgcttcttatcttggttctgtggcaaccgactgcctgctaacaggcgcttccagatcacctggtttgtatcatggaacccctgcctgccctgtgtggtgaaggtgaccaaattcttggctgagcaccccaatgtcaccctgaccatctctgccgcccgcctctactactaccgggatagagattggcggtgggtgctcctcaggctgcataaggcaggggcccgtgtgaagatcatggactatgaagactttgcatactgctgggaaaactttgtgtgcaatgaaggtcagccattcatgccttggtacaaattcgatgacaattatgcatccctgcaccgcacgctaaaggagattctcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtga

SEQ ID NO: 108143 - DNA, 1961 bp, Homo sapiens
  Payload ID: 1253
  Gene Symbol: APOBEC3D
  Gene Name: apolipoprotein B mRNA editing enzyme, catalytic polypeptide-like 3D
  ENST ID: ENST00000427494
  CDS Start-End: 408-1016
tttttttttttttgagaggaagcctcgctctctcacccaggctggagtgcagtggcaggaacttggctcactgcaacctccgcttcccaggttcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaaagtgctgggattacaggcgtgagccaccgtgcccggccgggaggtcactttaaggagggctgtccaactgcaaggagccgcaagcaggaagtgaaaccacagcacttcaaaaaaagagggagactgggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggcccggtactacccaaacgtcagtcgaatcacaggcaggaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtgaggggtctccctgggcctcatggtctgtctcttctagcctcctgctcatgctgcacgggcctcccctccatcctgcaccagctgtgcttttgcctggtcatcctgagcccctcctggcctcagggccattccatagtgcccccctgcctcaccacctcctccccgctctcccaggctcttcttgtagaggctctccatccacctccccagtcctgttcccccagcctgggtgcccctaacttgactcttcccatctccccagcataaccaaatcttttttttttttttttttttttgagacggagtttcactctgtcgcccagactagagtgcaatggctggatctcagctcactgcaaactctgcttactgggttcaagtgattctcctgtctcagcttctgagtagctgggattacagatgcctgccaccacgcccagctaatttttttttttttttttttttttttttgtatttttagtagtgactgggtttcaccatgttggccaggctggtcttgaactcctgacctcaggtgatctgcccatctctgtctcccaaagtgctgggattacgggcgtgagccacccggctcggccgcacaaccaaatcttattaaactcaatctagtctggccctggtgactcacgcctttcggaggcagaggtgggagaatcgcttgagcccagaagtttgagaccagcctgggccacacgacaaagccccatttctacaaaaaaaaataccaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcaagaccctgcctgaaaataaatcaataaatacactcaacctaaatggatatgaatata

SEQ ID NO: 108144 - DNA, 591 bp, Homo sapiens
  Payload ID: 1253
  Gene Symbol: APOBEC3D
  Gene Name: apolipoprotein B mRNA editing enzyme, catalytic polypeptide-like 3D
  ENST ID: ENST00000622217
  CDS Start-End: 19-591
gtatctaagaggctgaacatgaatccacagatcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgtgtacagtgatgatgagccattcaagccttggaagggactacaaaccaactttcgacttctgaaaagaaggctacgggagattctccagtga

SEQ ID NO: 108145 - DNA, 2694 bp, Homo sapiens
  Payload ID: 1254
  Gene Symbol: APOBEC3F
  Gene Name: apolipoprotein B mRNA editing enzyme, catalytic polypeptide-like 3F
  Uniprot ID: Q8IUX4
  ENST ID: ENST00000308521
  CDS Start-End: 358-1479
gtgctctgctggctcagcctggtgtggacccacctcgcgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaagaatttgcatactgctgggaaaactttgtgtacagtgaaggtcagccattcatgccttggtacaaattcgatgacaattatgcattcctgcaccgcacgctaaaggagattctcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaagattttaaatattgttgggaaaactttgtgtacaatgatgatgagccattcaagccttggaaaggactaaaatacaactttctattcctggacagcaagctgcaggagattctcgagtgaggggtctccccgggcctcatggtctgtctcctctagcctcctgctcatgttgtgcaggcctcccctccatcctggaccagctgtgcttttgcctggtcatcctgagcccctcctggcctcagggccattccatagtgctcccctgcctcaccacctcctctccgctctcccaggctcttcctgcagaggcctctttctgcctccatggctatccatccacccaccaagaccctgttccctgagcctgcatgcccctaacctgccttttcccatctccccagcataacctaatattttttttttttttttgagacggaatttcgctctgtcacccagactggagtgcaatggcttgatcttggctcactgcaaactctgcctaccaggttcaagcgattctcctgcctccgcctcccgagtagctggaattacagacgcctgccaccacgcacagctaactttttttttttttgtatttttagtagtgactgggtttcaccatgttggccaggctggtcttgaactcctgacctcaggtgatccgcctatctcagcctcccaaagtgctgggattacaggcgtgagccactggcccggcggcacaaccaaatcttattaaactcaccctaggctggccgcggtgactcatgcctataatcccccagcaatttgggaggcagaggtgagagaatcgcttgagcccaggaattcgagaccagcctgggccacatgacaaagccccatctctacaaaaaaattacaaaaaaaaaaaaaacaggtgtggtggcatgcacctgtagttgaagctacttggaaggatgaagtgggaggattgcttgagccggggaggtggaggctgcagtgaactgagatcacgtcactgaactccagtctgagcaacagatcgagaccctgcctgaaaataaatcaataaataaactcaaccgaaatgggtatgaaagttgaaatgggtatgtaagttgaaaaccagaagttttgagaaacatcctttgttaactttcatcctacaaattgggtcattcatgtcctacgcagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttgga

SEQ ID NO: 108146 - DNA, 616 bp, Homo sapiens
  Payload ID: 1254
  Gene Symbol: APOBEC3F
  Gene Name: apolipoprotein B mRNA editing enzyme, catalytic polypeptide-like 3F
  Uniprot ID: Q8IUX4
  ENST ID: ENST00000381565
  CDS Start-End: 105-410
ggaggtcactttagggagggctgtcctgaaacctggagcctggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgcccaggtctttcatcagagccccatttcaagtgctcagtagcccctttggccagtgcgccccaccacatgggacagcgcaggtccagtggcctccccagctgaccgcaggcagggaacaaggcagaccctagagggccaggccacagcaggggctgaggatgcctggtgaatggatgcctgggagaatggatgccagaattcacgcatgaggctctgaacagggctgggaaaacttccaaacgaagggaagctcatgtcttggtgcactttgtgatgatgcttcaacagcaggactgagatggggacatttacaataaacagaaatgtatgggctcga

SEQ ID NO: 108147 - DNA, 1834 bp, Homo sapiens
  Payload ID: 1255
  Gene Symbol: APOBEC3G
  Gene Name: apolipoprotein B mRNA editing enzyme, catalytic polypeptide-like 3G
  Uniprot ID: Q9HC16
  ENST ID: ENST00000407997
  CDS Start-End: 358-1512
gtgctctgctggctcagcctggtgtggacccacctcccgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactgaaggatgggcctcagtctctaaggaaggcagagacctgggttgagcctcagaataaaagatcttcttccaagaaatgcaaacaggctgttcaccaccatctccagctgatcacagacaccagcaaagcaatgcactcctgaccaagtagattcttttaaaaattagagtgcattactttgaatcaaaaatttatttatatttcaagaataaagtactaagattgtgctcaatacacagaaaagtttcaaacctactaatccagcgacaatttgaatcggttttgtaggtagaggaataaaatgaaatactaaatctttctgta

SEQ ID NO: 108148 - DNA, 1155 bp, Homo sapiens
  Payload ID: 1255
  Gene Symbol: APOBEC3G
  Gene Name: apolipoprotein B mRNA editing enzyme, catalytic polypeptide-like 3G
  Uniprot ID: Q9HC16
  ENST ID: ENST00000452957
  CDS Start-End: 1-1155
atgaagcctcacttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggctccacataaacacggtttccttgaaggccgccatgcagagctgtgcttcctggacgtgattcccttttggaagctggacctggaccaggactacagggttacctgcttcacctcctggagcccctgcttcagctgtgcccaggaaatggctaaattcatttcaaaaaacaaacacgtgagcctgtgcatcttcactgcccgcatctatgatgatcaaggaagatgtcaggaggggctgcgcaccctggccgaggctggggccaaaatttcaataatgacatacagtgaatttaagcactgctgggacacctttgtggaccaccagggatgtcccttccagccctgggatggactagatgagcacagccaagacctgagtgggaggctgcgggccattctccagaatcaggaaaactga

SEQ ID NO: 108149 - DNA, 1046 bp, Homo sapiens
  Payload ID: 1256
  Gene Symbol: APOBEC3H
  Gene Name: apolipoprotein B mRNA editing enzyme, catalytic polypeptide-like 3H
  Uniprot ID: Q6NTF7
  ENST ID: ENST00000348946
  CDS Start-End: 128-676
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagagtttgctgactgctgggaaaactttgtggaccacgagaaaccgctttccttcaacccctataagatgttagaggagctagataaaaacagtcgagccataaagcgacggcttgagaggataaagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaa

SEQ ID NO: 108150 - DNA, 1023 bp, Homo sapiens
  Payload ID: 1256
  Gene Symbol: APOBEC3H
  Gene Name: apolipoprotein B mRNA editing enzyme, catalytic polypeptide-like 3H
  Uniprot ID: Q6NTF7
  ENST ID: ENST00000401756
  CDS Start-End: 77-679
tgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagagtttgctgactgctgggaaaactttgtggaccacgagaaaccgctttccttcaacccctataagatgttagaggagctagataaaaacagtcgagccataaagcgacggcttgagaggataaagattccaggggtacgtgcgcagggtcgttacatggatatattgtgtgatgctgaggtctgagtcacccaatctactggaacatagcacccaatagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtgg

SEQ ID NO: 108151 - DNA, 592 bp, Homo sapiens
  Payload ID: 1256
  Gene Symbol: APOBEC3H
  Gene Name: apolipoprotein B mRNA editing enzyme, catalytic polypeptide-like 3H
  Uniprot ID: Q6NTF7
  ENST ID: ENST00000421988
  CDS Start-End: 128-592
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagattccaggggtacgtgcgcagggtcgttacatggatatattgtgtga

SEQ ID NO: 108152 - DNA, 988 bp, Homo sapiens
  Payload ID: 1256
  Gene Symbol: APOBEC3H
  Gene Name: apolipoprotein B mRNA editing enzyme, catalytic polypeptide-like 3H
  Uniprot ID: Q6NTF7
  ENST ID: ENST00000442487
  CDS Start-End: 67-618
tgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagagtttgctgactgctgggaaaactttgtggaccacgagaaaccgctttccttcaacccctataagatgttagaggagctagataaaaacagtcgagccataaagcgacggcttgagaggataaagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaa

SEQ ID NO: 108153 - DNA, 465 bp, Homo sapiens
  Payload ID: 1256
  Gene Symbol: APOBEC3H
  Gene Name: apolipoprotein B mRNA editing enzyme, catalytic polypeptide-like 3H
  ENST ID: ENST00000613996
  CDS Start-End: 1-465
atggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagattccaggggtacgtgcgcagggtcgttacatggatatattgtgtga

SEQ ID NO: 108154 - DNA, 730 bp, Homo sapiens
  Payload ID: 1256
  Gene Symbol: APOBEC3H
  Gene Name: apolipoprotein B mRNA editing enzyme, catalytic polypeptide-like 3H
  ENST ID: ENST00000613677
  CDS Start-End: 128-730
tgacttttgggagagctgaccttttgtgacttttgggagagctgccaaaagtgaaacttagtgcctcagacaagcaggggcaagtctgctaaggaagctgtggccagaagcacagatcagaaacacgatggctctgttaacagccgaaacattccgcttacagtttaacaacaagcgccgcctcagaaggccttactacccgaggaaggccctcttgtgttaccagctgacgccgcagaatggctccacgcccacgagaggctactttgaaaacaagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccagagtttgctgactgctgggaaaactttgtggaccacgagaaaccgctttccttcaacccctataagatgttagaggagctagataaaaacagtcgagccataaagcgacggcttgagaggataaagattccaggggtacgtgcgcagggtcgttacatggatatattgtgtgatgctgaggtctga

SEQ ID NO: 108155 - DNA, 2650 bp, Homo sapiens
  Payload ID: 1257
  Gene Symbol: APOBEC4
  Gene Name: apolipoprotein B mRNA editing enzyme, catalytic polypeptide-like 4 (putative)
  Uniprot ID: Q8WW27
  ENST ID: ENST00000308641
  CDS Start-End: 273-1376
agtgttcttagaggtagccacacctcagcaagggctttctaacttggaacagcaaagttcaaatgaacgaatagacacaaactgtgaaagagtcctgaacccattacaaggtgaatctttacagcacaattgccttctgaagctacttgaaacagggcatgggacttaaaggagaaaaaaaaggaaatggaccatctcttctaacacctggaatgtgatccaagcctggagacaaattgatggtttgcagctagaagacagtaaatctagcaatggagcccatatatgaggagtacctagcaaatcatggaacaatagtaaaaccatattactggctaagcttctctctcgattgctctaattgtccttaccatattcgaacaggtgaagaagcaagagtttccctcacagaattttgtcagatttttggattcccttatgggacaacatttcctcaaacaaaacacctcacattttatgaactaaaaacttcttctggtagcctggtgcaaaagggccatgctagcagttgcactgggaattatatccatccagaatcaatgctctttgaaatgaatggttatcttgactcagccatatacaataatgacagcatcaggcatatcattctgtattccaacaactccccttgtaatgaagctaaccactgctgcatcagcaaaatgtataatttcctgattacgtatccaggcatcactcttagtatttatttttctcagctctatcatactgagatggactttcctgcctcagcatggaaccgcgaagctctccggagcctggccagcttatggccgcgggttgttttgagtccaataagtggtgggatctggcattctgttctccacagctttataagtggtgtctcaggatcacatgtttttcagcccattttaactgggagagcactggctgacaggcacaacgcatatgaaatcaatgccataacaggcgtaaaaccttacttcactgatgttcttctccagacaaaaaggaatccaaacacaaaagctcaggaggctttagagagctaccccttaaacaatgcctttcctggacagttttttcaaatgccgagtggacaactccaacccaacctacctccagacctcagggctcctgttgtttttgtgctagtgcctctcagggacttaccaccaatgcatatgggccaaaacccaaataaacccaggaatatcgtaaggcacttaaatatgcctcaaatgtcattccaggaaaccaaggaccttggaaggcttcccactggaaggtcagtggagatagtggaaatcacagaacagtttgcaagtagcaaggaggcagatgaaaagaagaagaagaaagggaagaaataaaatctacattcctacagcatgaaaccaattaccaagggacttattagataggcaataaaaatctggaaactttctctctcagggctgagccaagatggagataaactgatgcactaaaagcaaaccttgaattatttaccatatcaactattataaagttacactattttaaacataatccaaaatgtttccataagcaacttgatctctctcctttattttgaaagtggcagtatcaaaatggaaccattagcagcttgctaatattttgatgcagaaaaggaatctcattattctattttactcacatcatctttccactacaaaagcccatggacaaaatagctacctaaatttgtttcggtaaaaaatttactgtaaaattgaaaaacagcctgaagctactgacattaagtgctgtttgcaggagcaaaccagtgattttctattaattgttaatcatggacagaagattttaggcagctcatttttttctaaagtgattcaaaatagttttgtgtgggaaaaagctcttctgctgattacatatagctataaagattaaaacctagccacctgctcagtttgatcttccccagctcagacctctcccttctgagcagatgatagaggtaagatgatacatgagaacctccaatggctcctgtcatcacatactgtataaaatccaagttcctcttactggctttcaaggatcctcctttaacttcctgttgccttgtctcatcagcaagatcataagtacctacaggtcaagcactgtctctcccttctctttagcttttcccttaggatctagcacattacccagcaaaatgtgagtagcaaggctgaaatgacatctcaataacttcaccaatgattgtaactcagcatcccttctccatcccagctgaaagcctgcttcaccatcctgcaagagatgttttttctttttgttagcatccattcccctttctaatgcagctcccaatgcataatgtgtgttttacttccctctttctgactccatcctcgtcaccagtgaatatttgtaccttctcttaaaatcttcaaaacacacttctaggaagtgctccttgattaatcctctaagcacttaaatgaaagcactttgcttatgcttatttcacatttgctgccacttgcctctttgaaatatgtaaagatacattacaagaaaaatgtacattttctcgtaacttgctattaatttttttctttatatatatatataaagtaatcctaagcta

SEQ ID NO: 108156 - DNA, 3765 bp, Homo sapiens
  Payload ID: 1258
  Gene Symbol: APOBR
  Gene Name: apolipoprotein B receptor
  Uniprot ID: Q0VD83
  ENST ID: ENST00000431282
  CDS Start-End: 34-3300
agctttctggacacacagacagagacagacaggatggacttcctccggctatacctccctgggctgcaccaggccttgaggggggcactggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagaagagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccaaggacctgagctgatggggggcgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggtgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcga

SEQ ID NO: 108157 - DNA, 3792 bp, Homo sapiens
  Payload ID: 1258
  Gene Symbol: APOBR
  Gene Name: apolipoprotein B receptor
  Uniprot ID: Q0VD83
  ENST ID: ENST00000564831
  CDS Start-End: 34-3327
agctttctggacacacagacagagacagacaggatggacttcctccggctatacctccctgggctgcaccaggccttgaggggggcactggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagaagagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccaaggacctgagctgatggggggcgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggtgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcga

SEQ ID NO: 108158 - DNA, 508 bp, Homo sapiens
  Payload ID: 1259
  Gene Symbol: APOC1
  Gene Name: apolipoprotein C-I
  ENST ID: ENST00000590334
  CDS Start-End: 24-275
cagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgtgaagatgacatttcaccatgttgcccaggttggtctcgaactcctgacctcaagtgatcagcctacctcggcctcccaaagtgttgggattacaggcgtgagccaaatgcccagccaaggggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacag

SEQ ID NO: 108159 - DNA, 689 bp, Homo sapiens
  Payload ID: 1259
  Gene Symbol: APOC1
  Gene Name: apolipoprotein C-I
  Uniprot ID: P02654
  ENST ID: ENST00000588750
  CDS Start-End: 326-577
tcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacag

SEQ ID NO: 108160 - DNA, 213 bp, Homo sapiens
  Payload ID: 1259
  Gene Symbol: APOC1
  Gene Name: apolipoprotein C-I
  ENST ID: ENST00000589078
  CDS Start-End: 53-213
ctgatcccctgaacccctgcctctgcctccagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccg

SEQ ID NO: 108161 - DNA, 425 bp, Homo sapiens
  Payload ID: 1259
  Gene Symbol: APOC1
  Gene Name: apolipoprotein C-I
  ENST ID: ENST00000586638
  CDS Start-End: 24-302
cagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctgggggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 108162 - DNA, 514 bp, Homo sapiens
  Payload ID: 1259
  Gene Symbol: APOC1
  Gene Name: apolipoprotein C-I
  ENST ID: ENST00000592176
  CDS Start-End: 24-143
cagagtgcccctccggcctcgccatgaggctcttcctgtcgctcccggtcctggtggtggttctgtcgatcgtcttggaaggttctcccaggctcagtcccgcaggcgccaaatctgcgcaggagagcactagcaaccgatgacgtattgaggcccacacctctgggattggctgtcctgcttcgacagccttgaaagtgggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattc

SEQ ID NO: 108163 - DNA, 562 bp, Homo sapiens
  Payload ID: 1259
  Gene Symbol: APOC1
  Gene Name: apolipoprotein C-I
  ENST ID: ENST00000592885
  CDS Start-End: 52-441
ctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaa

SEQ ID NO: 108164 - DNA, 273 bp, Homo sapiens
  Payload ID: 1259
  Gene Symbol: APOC1
  Gene Name: apolipoprotein C-I
  ENST ID: ENST00000589781
  CDS Start-End: 45-134
ccaagccctccagcaaggattcagagtgcccctccggcctcgccatgaggctcttcctgtcgctcccggtcctggtggtggttctgtcgatcgtcttggaagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacaga

SEQ ID NO: 108165 - DNA, 553 bp, Homo sapiens
  Payload ID: 1259
  Gene Symbol: APOC1
  Gene Name: apolipoprotein C-I
  Uniprot ID: P02654
  ENST ID: ENST00000588802
  CDS Start-End: 186-437
gagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 108166 - DNA, 430 bp, Homo sapiens
  Payload ID: 1259
  Gene Symbol: APOC1
  Gene Name: apolipoprotein C-I
  ENST ID: ENST00000592535
  CDS Start-End: 200-430
aacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggag

SEQ ID NO: 108167 - DNA, 880 bp, Homo sapiens
  Payload ID: 1260
  Gene Symbol: APOC2
  Gene Name: apolipoprotein C-II
  ENST ID: ENST00000585786
  CDS Start-End: 194-412
agaatgttggaaagtgaggcccaagaagggggctgtgtccaagtccatgcatgggaaacttgactgggacaccgagctcacacagagcaggatctcagtcccccccaccagagtggggcgtgaccacaggaacagccgcctccagtcagcctgccacatgacaccccctcaatgttccaggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggtagcacctgcccctggagaaatggggtctggcccataccaccgactgcatccaggacccagaagttcaggccccagcccctcctccctcagacccaggagtccaggcctcagcccctcctccctcagacccaggagtccaggcccccagcccgtcctccctcagacccaggagtccaggcccccagcccctcctccctcagacccaggagtccaggtccccagaccctcctccctcagacccaggagtccaggcccccagcccctcctccctctaaccatctgtgctttctccccagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttccca

SEQ ID NO: 108168 - DNA, 744 bp, Homo sapiens
  Payload ID: 1260
  Gene Symbol: APOC2
  Gene Name: apolipoprotein C-II
  Uniprot ID: P02655
  ENST ID: ENST00000590360
  CDS Start-End: 123-428
tcagatctcaccctctttctgccgtacttcctcatctcctacgtgtggatgatgatattgtgccctgtgcatgttcttcgtcaccaaaagtgcctctctcatagagcaggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacagcaa

SEQ ID NO: 108169 - DNA, 447 bp, Homo sapiens
  Payload ID: 1260
  Gene Symbol: APOC2
  Gene Name: apolipoprotein C-II
  ENST ID: ENST00000591597
  CDS Start-End: 34-297
ggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttg

SEQ ID NO: 108170 - DNA, 444 bp, Homo sapiens
  Payload ID: 1260
  Gene Symbol: APOC2
  Gene Name: apolipoprotein C-II
  ENST ID: ENST00000592257
  CDS Start-End: 55-198
gtgcccgtccggagctggtgaggacagcctgccagagtctggtctctggacactatgggcacacgactcctcccagctctgtttcttgtcctcctggtattgggatttggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaa

SEQ ID NO: 108171 - DNA, 550 bp, Homo sapiens
  Payload ID: 1261
  Gene Symbol: APOC3
  Gene Name: apolipoprotein C-III
  Uniprot ID: P02656
  ENST ID: ENST00000227667
  CDS Start-End: 63-362
aaccctcctgcctgtctgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 108172 - DNA, 604 bp, Homo sapiens
  Payload ID: 1261
  Gene Symbol: APOC3
  Gene Name: apolipoprotein C-III
  ENST ID: ENST00000375345
  CDS Start-End: 63-416
ttcatccctagaggcagctgctccaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatga

SEQ ID NO: 108173 - DNA, 359 bp, Homo sapiens
  Payload ID: 1261
  Gene Symbol: APOC3
  Gene Name: apolipoprotein C-III
  ENST ID: ENST00000433777
  CDS Start-End: 195-359
ggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtg

SEQ ID NO: 108174 - DNA, 541 bp, Homo sapiens
  Payload ID: 1261
  Gene Symbol: APOC3
  Gene Name: apolipoprotein C-III
  ENST ID: ENST00000630701
  CDS Start-End: 1-354
atggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 108175 - DNA, 348 bp, Homo sapiens
  Payload ID: 1262
  Gene Symbol: APOC4
  Gene Name: apolipoprotein C-IV
  ENST ID: ENST00000591600
  CDS Start-End: 5-226
agaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtgagggtgtgctgggctgggtggtgggaggggactcctgggtctgagggaggaggggctggggcctggacccctgagtctcagggaggaggaaagggtgggagtggggctgtgacccctaggtct

SEQ ID NO: 108176 - DNA, 615 bp, Homo sapiens
  Payload ID: 1262
  Gene Symbol: APOC4
  Gene Name: apolipoprotein C-IV
  Uniprot ID: P55056
  ENST ID: ENST00000592954
  CDS Start-End: 41-424
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtg

SEQ ID NO: 108177 - DNA, 1130 bp, Homo sapiens
  Payload ID: 1263
  Gene Symbol: APOD
  Gene Name: apolipoprotein D
  Uniprot ID: P05090
  ENST ID: ENST00000343267
  CDS Start-End: 363-932
tctctctcgcacacatacccacacacacacacacacacacacacgcgcgcgcgaaaacaatatctcatttcttcttcagggagcagctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccccccccataaagacaaaccaatcaaccacgacaaaggaagttgacctgaacatgtaaccatgccctaccctgttaccttgctagctgcaaaataaacttgttgctgacctgctgtgctcgcagtagattccaagtt

SEQ ID NO: 108178 - DNA, 950 bp, Homo sapiens
  Payload ID: 1263
  Gene Symbol: APOD
  Gene Name: apolipoprotein D
  ENST ID: ENST00000458447
  CDS Start-End: 112-438
agaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagacggagtctcactttgtcacccagggtggagtgcagcatcaccatcttggctcactgcaacctccgcctcccgggttcaagcaattctcctgcctcagcctcccaagtagctgggactacagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccccccccataaagacaaaccaatcaaccacgacaaaggaagttgacctgaacatgtaaccatgccctaccctgttaccttgctagc

SEQ ID NO: 108179 - DNA, 681 bp, Homo sapiens
  Payload ID: 1263
  Gene Symbol: APOD
  Gene Name: apolipoprotein D
  ENST ID: ENST00000453131
  CDS Start-End: 234-681
aagacaggcatctcaaatcggctgattctgcatctggaaactgccttcatcttgaaagaaaagtttaccaggaagtaacccgggcaaattcacctcgttggtatgaagagagtgtcagcagaggtcgcctccagaggaggtgctgtggagactgagcgcatagcacccttaaaatcctgggaccagggcttctccacggctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttgg

SEQ ID NO: 108180 - DNA, 782 bp, Homo sapiens
  Payload ID: 1263
  Gene Symbol: APOD
  Gene Name: apolipoprotein D
  ENST ID: ENST00000421243
  CDS Start-End: 137-782
aagacaggcatctcaaatcggctgattctgcatctggaaactgccttcatcttgaaagaaaagatggagtttttgctctgttgcccaagctagagtgcaatggtgtgatcttggcttactgcaacctctgcctcccatgttcaagcaattatcctgcatcagcctcccgagtagctgtgattacagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagc

SEQ ID NO: 108181 - DNA, 1208 bp, Homo sapiens
  Payload ID: 1264
  Gene Symbol: APOE
  Gene Name: apolipoprotein E
  Uniprot ID: P02649
  ENST ID: ENST00000252486
  CDS Start-End: 112-1065
agggggagccctataattggacaagtctgggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 108182 - DNA, 923 bp, Homo sapiens
  Payload ID: 1264
  Gene Symbol: APOE
  Gene Name: apolipoprotein E
  ENST ID: ENST00000425718
  CDS Start-End: 266-923
ccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagc

SEQ ID NO: 108183 - DNA, 737 bp, Homo sapiens
  Payload ID: 1264
  Gene Symbol: APOE
  Gene Name: apolipoprotein E
  ENST ID: ENST00000446996
  CDS Start-End: 90-737
gagtcctactcagccccagcggaggtgaaggacgtccttccccaggagccgtttctccttccccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctg

SEQ ID NO: 108184 - DNA, 864 bp, Homo sapiens
  Payload ID: 1264
  Gene Symbol: APOE
  Gene Name: apolipoprotein E
  ENST ID: ENST00000434152
  CDS Start-End: 58-864
gaggtgaaggacgtccttccccaggagccggtgagaagcgcagtcgggggcacggggatgagctcaggggcctctagaaagagctgggaccctgggaacccctggcctccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacc

SEQ ID NO: 108185 - DNA, 1715 bp, Homo sapiens
  Payload ID: 1265
  Gene Symbol: APOF
  Gene Name: apolipoprotein F
  Uniprot ID: Q13790
  ENST ID: ENST00000398189
  CDS Start-End: 79-1059
cctttcctcatgggacacagaactaggcagaacaggatcaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcatt

SEQ ID NO: 108186 - DNA, 1176 bp, Homo sapiens
  Payload ID: 1266
  Gene Symbol: APOH
  Gene Name: apolipoprotein H (beta-2-glycoprotein I)
  Uniprot ID: P02749
  ENST ID: ENST00000205948
  CDS Start-End: 39-1076
gaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttattgccgca

SEQ ID NO: 108187 - DNA, 407 bp, Homo sapiens
  Payload ID: 1266
  Gene Symbol: APOH
  Gene Name: apolipoprotein H (beta-2-glycoprotein I)
  ENST ID: ENST00000585162
  CDS Start-End: 1-313
acaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagaacacagttctctggctttttggaaaactgatgcatccgatgtaaagccatgctaaggtggttttcagattccacacaaaatgtcacacttgtttcttgttcatccaaggaacctaattgaaatttaaaaataaagctactgaatttatt

SEQ ID NO: 108188 - DNA, 748 bp, Homo sapiens
  Payload ID: 1266
  Gene Symbol: APOH
  Gene Name: apolipoprotein H (beta-2-glycoprotein I)
  ENST ID: ENST00000581797
  CDS Start-End: 148-748
agtagagacggggtttcaccgtgttagccagcctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgta

SEQ ID NO: 108189 - DNA, 707 bp, Homo sapiens
  Payload ID: 1266
  Gene Symbol: APOH
  Gene Name: apolipoprotein H (beta-2-glycoprotein I)
  ENST ID: ENST00000577982
  CDS Start-End: 164-707
ggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttg

SEQ ID NO: 108190 - DNA, 4724 bp, Homo sapiens
  Payload ID: 1267
  Gene Symbol: APOLD1
  Gene Name: apolipoprotein L domain containing 1
  Uniprot ID: Q96LR9
  ENST ID: ENST00000326765
  CDS Start-End: 71-910
cgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaa

SEQ ID NO: 108191 - DNA, 4646 bp, Homo sapiens
  Payload ID: 1267
  Gene Symbol: APOLD1
  Gene Name: apolipoprotein L domain containing 1
  Uniprot ID: Q96LR9
  ENST ID: ENST00000356591
  CDS Start-End: 86-832
gcagccattggttctctggaactataaagcacactcatccagaaacagcctcagattttactttcctggaggcagacagaagtgaatgggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaa

SEQ ID NO: 108192 - DNA, 574 bp, Homo sapiens
  Payload ID: 1267
  Gene Symbol: APOLD1
  Gene Name: apolipoprotein L domain containing 1
  ENST ID: ENST00000540583
  CDS Start-End: 85-207
agtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaagagcgtttttgcgggaggaatatgttaaaacaaactcaagatacgaaatgagacttttgaagtgcctttgatttctggcctacgcgcccatattcactgggccccacctgcctagcggacgggtgcaatccccggcaagcccgcagggggcgcgcagagcacgtcgtccggggagaactaaaactacatttcccagcatcccgcgcgccgcagacccacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagatt

SEQ ID NO: 108193 - DNA, 2375 bp, Homo sapiens
  Payload ID: 1267
  Gene Symbol: APOLD1
  Gene Name: apolipoprotein L domain containing 1
  ENST ID: ENST00000534843
  CDS Start-End: 73-195
ggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaagagcgtttttgcgggaggaatatgttaaaacaaactcaagatacgaaatgagacttttgaagtgcctttgatttctggtgacggacaccagattgcccccaacttcccatcctcaggaataaaactgcaacgagcaccctgcgcagtgtgagacccaagtgacaggccacaggagggcactcgctggccatggggcatgcaacatacagctctgaatttgctgctttccagaatagccttagtagcttcacagtcttgcctacgcgcccatattcactgggccccacctgcctagcggacgggtgcaatccccggcaagcccgcagggggcgcgcagagcacgtcgtccggggagaactaaaactacatttcccagcatcccgcgcgccgcagacccacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattattttt

SEQ ID NO: 108194 - DNA, 3000 bp, Homo sapiens
  Payload ID: 1268
  Gene Symbol: APOL1
  Gene Name: apolipoprotein L, 1
  Uniprot ID: O14791
  ENST ID: ENST00000319136
  CDS Start-End: 268-1512
actttccctttcgaattcctcggtatatcttggggactggaggacctgtctggttattatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactca

SEQ ID NO: 108195 - DNA, 2918 bp, Homo sapiens
  Payload ID: 1268
  Gene Symbol: APOL1
  Gene Name: apolipoprotein L, 1
  Uniprot ID: O14791
  ENST ID: ENST00000397278
  CDS Start-End: 230-1426
tggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 108196 - DNA, 1564 bp, Homo sapiens
  Payload ID: 1268
  Gene Symbol: APOL1
  Gene Name: apolipoprotein L, 1
  Uniprot ID: O14791
  ENST ID: ENST00000397279
  CDS Start-End: 99-1295
gacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtc

SEQ ID NO: 108197 - DNA, 2808 bp, Homo sapiens
  Payload ID: 1268
  Gene Symbol: APOL1
  Gene Name: apolipoprotein L, 1
  Uniprot ID: O14791
  ENST ID: ENST00000426053
  CDS Start-End: 169-1311
gactttcactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgg

SEQ ID NO: 108198 - DNA, 561 bp, Homo sapiens
  Payload ID: 1268
  Gene Symbol: APOL1
  Gene Name: apolipoprotein L, 1
  ENST ID: ENST00000422471
  CDS Start-End: 109-534
ttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtgagcacacagaatctgctactcctgctga

SEQ ID NO: 108199 - DNA, 624 bp, Homo sapiens
  Payload ID: 1268
  Gene Symbol: APOL1
  Gene Name: apolipoprotein L, 1
  ENST ID: ENST00000427990
  CDS Start-End: 146-624
attatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgc

SEQ ID NO: 108200 - DNA, 541 bp, Homo sapiens
  Payload ID: 1268
  Gene Symbol: APOL1
  Gene Name: apolipoprotein L, 1
  ENST ID: ENST00000433768
  CDS Start-End: 118-541
atccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagt

SEQ ID NO: 108201 - DNA, 550 bp, Homo sapiens
  Payload ID: 1268
  Gene Symbol: APOL1
  Gene Name: apolipoprotein L, 1
  ENST ID: ENST00000431184
  CDS Start-End: 76-504
cacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacagagagcagtatctttattgaggatgccattaagtatttc

SEQ ID NO: 108202 - DNA, 531 bp, Homo sapiens
  Payload ID: 1268
  Gene Symbol: APOL1
  Gene Name: apolipoprotein L, 1
  ENST ID: ENST00000439680
  CDS Start-End: 107-478
attatacagacgcataactggaggtgggatccacacagctcagaacagctggatcttgctcagtctctgccaggggaagattccttggaggaggccctgcagcgacatggagggagctgctttgctgagagtctctgtcctctgcatctgggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtgagcacacagaatctgctactcctgctgactgataatgaggcctggaacggattc

SEQ ID NO: 108203 - DNA, 566 bp, Homo sapiens
  Payload ID: 1268
  Gene Symbol: APOL1
  Gene Name: apolipoprotein L, 1
  ENST ID: ENST00000438034
  CDS Start-End: 213-566
attatacagacgcataactggaggtgggatccacacagctcagaacagctggatcttgctcagtctctgccaggggaagattccttgacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgact

SEQ ID NO: 108204 - DNA, 2901 bp, Homo sapiens
  Payload ID: 1268
  Gene Symbol: APOL1
  Gene Name: apolipoprotein L, 1
  Uniprot ID: O14791
  ENST ID: ENST00000422706
  CDS Start-End: 208-1404
gactttcactttccctttcgaattcctcggtatatcttggggactggaggacctgtctggttattatacagacgcataactggaggtgggatccacacagctcagaacagctggatcttgctcagtctctgccaggggaagattccttggaggagcacactgtctcaacccctcttttcctgctcaaggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgg

SEQ ID NO: 108205 - DNA, 2685 bp, Homo sapiens
  Payload ID: 1269
  Gene Symbol: APOL2
  Gene Name: apolipoprotein L, 2
  Uniprot ID: Q9BQE5
  ENST ID: ENST00000249066
  CDS Start-End: 478-1491
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 108206 - DNA, 2551 bp, Homo sapiens
  Payload ID: 1269
  Gene Symbol: APOL2
  Gene Name: apolipoprotein L, 2
  Uniprot ID: Q9BQE5
  ENST ID: ENST00000358502
  CDS Start-End: 337-1350
gtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcaccaagctgga

SEQ ID NO: 108207 - DNA, 577 bp, Homo sapiens
  Payload ID: 1269
  Gene Symbol: APOL2
  Gene Name: apolipoprotein L, 2
  ENST ID: ENST00000454728
  CDS Start-End: 355-577
ggtatatctgggaggccggaggacgtgtctggttattacacagatgcacagctggacgtgggatccacacagctcagaacagttggatcttgctcagtctctgtcagaggaagatcccttgaaaagactactgagagccagtaagactgaaagaatggacatcttcatatcctgttagtttgagtgtgaatttgtacagttttcatacagagtggctctaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagacc

SEQ ID NO: 108208 - DNA, 1421 bp, Homo sapiens
  Payload ID: 1269
  Gene Symbol: APOL2
  Gene Name: apolipoprotein L, 2
  ENST ID: ENST00000451256
  CDS Start-End: 10-1359
attacacagatgcacagctggacgtgggatccacacagctcagaacagttggatcttgctcagtctctgtcagaggaagatcccttgtcaagcctgaggggcagtatccagcctcaacccccagcagaggctccagacaaaggtgggagccaggccaacaatgacccaggaggatgggatcctggatgcagctcctcacaagtattgggcaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagac

SEQ ID NO: 108209 - DNA, 611 bp, Homo sapiens
  Payload ID: 1269
  Gene Symbol: APOL2
  Gene Name: apolipoprotein L, 2
  ENST ID: ENST00000529194
  CDS Start-End: 226-611
ggggaaaacagcttagatgggttcacaaagctccccgggctcagctctggttctgacaccctcagacacggccagctgaccccagaagaaaggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcat

SEQ ID NO: 108210 - DNA, 2117 bp, Homo sapiens
  Payload ID: 1270
  Gene Symbol: APOL3
  Gene Name: apolipoprotein L, 3
  Uniprot ID: O95236
  ENST ID: ENST00000349314
  CDS Start-End: 39-1247
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108211 - DNA, 3563 bp, Homo sapiens
  Payload ID: 1270
  Gene Symbol: APOL3
  Gene Name: apolipoprotein L, 3
  Uniprot ID: O95236
  ENST ID: ENST00000361710
  CDS Start-End: 2085-2693
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108212 - DNA, 3626 bp, Homo sapiens
  Payload ID: 1270
  Gene Symbol: APOL3
  Gene Name: apolipoprotein L, 3
  Uniprot ID: O95236
  ENST ID: ENST00000397287
  CDS Start-End: 2148-2756
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108213 - DNA, 2214 bp, Homo sapiens
  Payload ID: 1270
  Gene Symbol: APOL3
  Gene Name: apolipoprotein L, 3
  ENST ID: ENST00000397289
  CDS Start-End: 39-332
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108214 - DNA, 2214 bp, Homo sapiens; identical to SEQ ID NO: 108213
  Payload ID: 1270
  Gene Symbol: APOL3
  Gene Name: apolipoprotein L, 3
  Uniprot ID: O95236
  ENST ID: ENST00000397293
  CDS Start-End: 736-1344

SEQ ID NO: 108215 - DNA, 576 bp, Homo sapiens
  Payload ID: 1270
  Gene Symbol: APOL3
  Gene Name: apolipoprotein L, 3
  ENST ID: ENST00000426939
  CDS Start-End: 1-157
ttatgcagatgcacggctggaggtgggatccacacagctcagaacagctggatcttgctcacactctttcaagagaagcttccttgggttaagaaaaaaaacgaacccttccagtcaggtcagtgactggagagctccatggaaagtctctcagtgacctggctgctggcaccatggactcagaaaagaaacgctttactgaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgct

SEQ ID NO: 108216 - DNA, 2327 bp, Homo sapiens
  Payload ID: 1270
  Gene Symbol: APOL3
  Gene Name: apolipoprotein L, 3
  ENST ID: ENST00000422426
  CDS Start-End: 39-287
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108217 - DNA, 1240 bp, Homo sapiens
  Payload ID: 1270
  Gene Symbol: APOL3
  Gene Name: apolipoprotein L, 3
  Uniprot ID: O95236
  ENST ID: ENST00000424878
  CDS Start-End: 72-1067
gaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaa

SEQ ID NO: 108218 - DNA, 2443 bp, Homo sapiens
  Payload ID: 1270
  Gene Symbol: APOL3
  Gene Name: apolipoprotein L, 3
  ENST ID: ENST00000432700
  CDS Start-End: 39-287
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacca

SEQ ID NO: 108219 - DNA, 295 bp, Homo sapiens
  Payload ID: 1270
  Gene Symbol: APOL3
  Gene Name: apolipoprotein L, 3
  ENST ID: ENST00000531095
  CDS Start-End: 1-123
tctcagagcctggagaacgtgtctggttattatgcagatgcacggctggaggtgggatccacacagctcagaacagctggatcttgctcacactctttcaagagaagcttccttggagaataacacagcccttctgggagtccacgccagcttccaaatgtctgtggcagctcttccttcattctcaacacttacgaacaggaacataaataaatagaaggaaaaatatccatttatattaagatgctcttcttgttaaaaccaattaacaattaaacattctctgttacgataa

SEQ ID NO: 108220 - DNA, 462 bp, Homo sapiens
  Payload ID: 1270
  Gene Symbol: APOL3
  Gene Name: apolipoprotein L, 3
  ENST ID: ENST00000472303
  CDS Start-End: 1-260
attatgcagatgcacggctggaggtgggatccacacagctcagaacagctggatcttgctcacactctttcaagagaagcttccttgcgtggtggtatgtacctgtagggacaactacttgggaagttgaagcagaagcatcacttgcagccaggacatacaggcagaagcaagggggacaaagggtgtccagcacagcaccagtgaattcaccaagacagacacttgggcatagagtgcaagacacagatttggaatgaggagtcatttacaataagcatgacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccatggaaagtctctcag

SEQ ID NO: 108221 - DNA, 1005 bp, Homo sapiens
  Payload ID: 1270
  Gene Symbol: APOL3
  Gene Name: apolipoprotein L, 3
  ENST ID: ENST00000487355
  CDS Start-End: 1-101
attatgcagatgcacggctggaggtgggatccacacagctcagaacagctggatcttgctcacactctttcaagagaagcttccttgagatgagcatctagatagcaaggaaaaacattcaatccctcaactgaaagtgaaactgaagctgggccatgttgtccagaggctggttgcttttagtccaagtgctgcctcccacacctcggatttcagccaggctgtgccacggagggcagaggccacccagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtga

SEQ ID NO: 108222 - DNA, 569 bp, Homo sapiens
  Payload ID: 1270
  Gene Symbol: APOL3
  Gene Name: apolipoprotein L, 3
  ENST ID: ENST00000531195
  CDS Start-End: 1-157
ttatgcagatgcacggctggaggtgggatccacacagctcagaacagctggatcttgctcacactctttcaagagaagcttccttgggttaagaaaaaaaacgaacccttccagtcaggtcagtgactggagagctccatggaaagtctctcagtgacctggctgctggcaccatggactcagattttgaagacactggtgtaaagcgtttgacaataggcacatggcagaaggaagcgatcactggaatatttcccgtacatggggagaaagcatggtggaaagctcactttctggtgattctcagctgaaatagatcggttcctccacaaagcaccatggcacttccctggtgaatcactcttctcaggatgccttagtaaaacgccacaggctgggtggctccaacaactgatgtattttctcacagttctggaggcaaaaattccaagaaaagaaacgctttactgaagaggccaccaaatacttccgggagagagtcagcccagtgcatctgcaaatcctgctgactaacaatgaagcctggaagagattcgtgactgcggctg

SEQ ID NO: 108223 - DNA, 563 bp, Homo sapiens
  Payload ID: 1270
  Gene Symbol: APOL3
  Gene Name: apolipoprotein L, 3
  ENST ID: ENST00000530895
  CDS Start-End: 1-113
attatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccatggaaagtctctcagtgacctggctgctggcaccatggactcagattttgaagacactggtgtaaagcgtttgacaataggcacatggcagaaggaagcgatcactggaatatttcccgtacatggggagaaagcatggtggaaagctcactttctggtgattctcagctgaaatagatcggttcctccacaaa

SEQ ID NO: 108224 - DNA, 547 bp, Homo sapiens
  Payload ID: 1270
  Gene Symbol: APOL3
  Gene Name: apolipoprotein L, 3
  ENST ID: ENST00000487783
  CDS Start-End: 1-119
attatgcagatgcacggctggaggtgggatccacacagctcagaacagctggatcttgctcacactctttcaagagaagcttccttgcttggttaccccagccaccgaggtttctctgaagctgacatttctcccatcaggaggcaggtgtatttctctttggcacttgctcacacttctccatcaactttaaggtggtggcaccacaatccaaaccattattgaggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactg

SEQ ID NO: 108225 - DNA, 844 bp, Homo sapiens
  Payload ID: 1271
  Gene Symbol: APOL4
  Gene Name: apolipoprotein L, 4
  ENST ID: ENST00000328429
  CDS Start-End: 334-657
atcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcgggacaagcggacttttccttggtgtgagagtgagggaagagggagctggaatgaggtgcagcaaaaccatccaggctggacagtggctggacagttccaagggtcctctgggcccatcccctccccctgtccctacagctggttacagcagctccttctgtgtccattatgtgaacctgctgcctggagttcttgttctttctgtgacctcccagtatccacatctcagcatggccctctgtcagctggctgctcatgactggccgaggttaagctgtgtttgtgtctgacagaagcgcccatctgatatgaccccagttcagattcatagcttgcagtttcatggggggttacagctgttctgaaggtctggttggttttgtttgcccgggaatgtttcaggtctggtttttattttaattttgctttaatattcaccatccccaccccatcaataaaacacaaatttagtgctgg

SEQ ID NO: 108226 - DNA, 1825 bp, Homo sapiens
  Payload ID: 1271
  Gene Symbol: APOL4
  Gene Name: apolipoprotein L, 4
  Uniprot ID: Q9BPW4
  ENST ID: ENST00000332987
  CDS Start-End: 501-1547
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggtgagcttggctcagagccctgaggtgggagggagggctccctgtctgggctgcacaattgggcagggcttgggctgggccaggagccatgtgggtttttctaggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctc

SEQ ID NO: 108227 - DNA, 3227 bp, Homo sapiens
  Payload ID: 1271
  Gene Symbol: APOL4
  Gene Name: apolipoprotein L, 4
  Uniprot ID: Q9BPW4
  ENST ID: ENST00000352371
  CDS Start-End: 226-1281
gaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtgttcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgcca

SEQ ID NO: 108228 - DNA, 845 bp, Homo sapiens
  Payload ID: 1271
  Gene Symbol: APOL4
  Gene Name: apolipoprotein L, 4
  ENST ID: ENST00000397275
  CDS Start-End: 334-657
atcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcgggacaagcggacttttccttggtgtgagagtgagggaagagggagctggaatgaggtgcagcaaaaccatccaggctggacagtggctggacagttccaagggtcctctgggcccatcccctccccctgtccctacagctggttacagcagctccttctgtgtccattatgtgaacctgctgcctggagttcttgttctttctgtgacctcccagtatccacatctcagcatggccctctgtcagctggctgctcatgactggccgaggttaagctgtgtttgtgtctgacagaagcgcccatctgatatgaccccagttcagattcatagcttgcagtttcatggggggttacagctgttctgaaggtctggttggttttgtttgcccgggaatgtttcaggtctggtttttattttaattttgctttaatattcaccatccccaccccatcaataaaacacaaatttagtgctgga

SEQ ID NO: 108229 - DNA, 512 bp, Homo sapiens
  Payload ID: 1271
  Gene Symbol: APOL4
  Gene Name: apolipoprotein L, 4
  ENST ID: ENST00000436763
  CDS Start-End: 436-512
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggagcacactgtctcaacccctcttttcctgcccaaggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagtt

SEQ ID NO: 108230 - DNA, 543 bp, Homo sapiens
  Payload ID: 1271
  Gene Symbol: APOL4
  Gene Name: apolipoprotein L, 4
  ENST ID: ENST00000419360
  CDS Start-End: 350-543
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgt

SEQ ID NO: 108231 - DNA, 520 bp, Homo sapiens
  Payload ID: 1271
  Gene Symbol: APOL4
  Gene Name: apolipoprotein L, 4
  ENST ID: ENST00000457630
  CDS Start-End: 305-520
gtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctgcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagag

SEQ ID NO: 108232 - DNA, 616 bp, Homo sapiens
  Payload ID: 1271
  Gene Symbol: APOL4
  Gene Name: apolipoprotein L, 4
  ENST ID: ENST00000493203
  CDS Start-End: 144-356
acttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccaggtaacctccatggggttacctccttggggcaccccggtgatgccacccagatctccccgggctagttttctctggcaggcacacctcctccaggcagccccctctgctgggcttgaggatgtccctctcagcagtgcaggaagaatatttcctccaagtgcttcgctggcagtgagtgacctcaggctgaggggagaagaagcccacaagggcaggggaagaggcagatgctctctatgaagctctgaagaatcttacaccata

SEQ ID NO: 108233 - DNA, 3423 bp, Homo sapiens
  Payload ID: 1271
  Gene Symbol: APOL4
  Gene Name: apolipoprotein L, 4
  Uniprot ID: Q9BPW4
  ENST ID: ENST00000616056
  CDS Start-End: 431-1477
actgcaggaggtgctggggagcagcgtgtttgctgtgcttgattgtgagctgctgggaagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgacatggagggagctgctttgctgaaaatctttgtcgtctgcatctggaaccaaaatcacttcccggaattgaccaactggtagactcgcctagaggggacgcactgtgtcctagttgaggctaacagtcagtatccagcctcaacattcagcagaggccccagatcagcgtctgagccaggccaacaatgaccaaggaggatgggatcctgggtgcagctcatcacaagcgtcggggtgcagcaaaaccatccaggctggacagtggctggacagttccaagaaaagaaacgcttcactgaagaagtcattgaatacttccagaagaaagttagcccagtgcatctgaaaatcctgctgactagcgatgaagcctggaagagatttgtgcgtgtggctgaattgcccagggaagaggcagatgctctctatgaagctctgaagaatcttacaccatatgtggctattgaggacaaagacatgcagcaaaaagaacagcagtttagggagtggtttttgaaagagtttcctcaaatcagatggaagattcaggagtccatagaaaggcttcgtgtcattgcaaatgagattgaaaaggtccacagaggctgcgtcatcgccaatgtggtgtctggctccactggcatcctgtctgtcattggcgttatgttggcaccatttacagcagggctgagcctgagcattactgcagctggggtagggctgggaatagcatctgccacggctgggatcgcctccagcatcgtggagaacacatacacaaggtcagcagaactcacagccagcaggctgactgcaaccagcactgaccaattggaggcattaagggacattctgcgtgacatcacacccaatgtgctttcttttgcacttgattttgacgaagccacaaaaatgattgcgaatgatgtccatacactcaggagatctaaagccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcagggaccccaaacggagggactggctgaagccatggcagaagaacgtggattgtgaagatttcatggacatttattagttccccaaattaatacttttataatttcctatgcctgtctttaccgcaatctctaaacacaaattgtgaagatttcatggacactgatcacttccccaatcaatacccttgtgatttcttatgcctgtctttactttaatctcctaatcctgtcagctgaggaggatgtatgtcacctcaggaccatgtgataattgcgttaactgcacaaattgtagagcatgtgtgtttgaacaatatgaaatctgggcaccttgaaaaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgctctcaaaaccctgtctcctgataagatgttatcaatgacaatggtgcccgaaacctcattagcaattttaatttctccccggtcctgtgttcctgtgatctcgccctgcctccacttgccttgtgatattctattaccttgtgaagtaggtgatctttgtgacccacacccacaccctattcatacactccctccccttttgaaagtccctaataaaaacttgctggttttgcggcttgtgaggcatcacggaacctaccgatgtgtgatgtctcccctggacacctagctttaaaatttctctcttttgtactctgtgcctttatttctcaaaccggccaacacttagggaaaatagaaaagaacctacgtgaccatcggggcaggttccccgatacccaatgaccccagagcagtgcagccaccagggaaggtgagccagacacaggccgggacaaaacgcagacattttttaggggaataaagagggcgaggtaaagtttatggaactcagtgttaggaactttggcatctgtagctgagcacagcaggggaggggttactcaagatggcaagtgcgccaaggagaaggcagaaatgctggggcctggaataagggaggagaggggactggagagtgtggggaatggaaagaagcagtttactctagactaaagagtatattgggggaggaagagagggaggcacgtaggaacaagcaatgagaagaccaggaaaagaaagagctgaaaatggagaaagccacagttagaactgttggatacaggagaagaaacagcggctccactaaagacccgccccccggttggatgtccttccaagaatggaatccttccctggtgatggtctctcaccctgtcttaccagcatccactctcccttgtcctcccgggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtctcgttgctcatatatagtagacaaagagccagaaaattaactgaaaagcagtttagacattgggggaggctggatctctcgagctgtcttgctgagtgccctgtgtgtaagtcctaataaacttagctactcgcca

SEQ ID NO: 108234 - DNA, 1438 bp, Homo sapiens
  Payload ID: 1272
  Gene Symbol: APOL5
  Gene Name: apolipoprotein L, 5
  Uniprot ID: Q9BWW9
  ENST ID: ENST00000249044
  CDS Start-End: 1-1302
atgccatgtggcaaacaaggaaatttgcaagttcccggttccaaggtgttacctggcttgggagaaggttgtaaagaaatgtggcttcgaaaggtaatctacggaggtgaggtctgggggaagtccccagaacctgagttcccctcactcgtgaacctgtgccagagttggaaaattaacaatttgatgtcaactgtccacagtgatgaggctggtatgctgtcctactttctgtttgaagagctgatgcgatgtgacaaagattccatgccagatggaaatctgtcagaggaggaaaaattgtttctctcatattttcctttgcacaagtttgagctagaacagaacatcaaagaacttaacacccttgcggaccaagttgacaccactcacgagttgcttaccaagaccagcctggtggccagctcttccggggctgtttctggggtcatgaacatcctgggtttggccctagcacctgtgacagcaggaggcagtctcatgctctcagcaactgggacagggttgggggcagcagctgccatcaccaacatagtaacaaatgtcttagaaaatagaagcaattcagcagcaagagacaaagccagccgactggggcctctgacaacatcacatgaggctttcggaggaataaattggtctgaaatcgaggctgctggcttttgtgttaataagtgtgtaaaagctatccagggcatcaaggatcttcatgcctaccagatggccaaatccaactctggcttcatggctatggtcaagaattttgtggccaagagacacatccctttctggacggctagaggggtgcagagagcctttgagggcacaactctggccatgaccaatggtgcctgggtgatgggtgctgctggggctggcttcttacttatgaaagacatgagcagcttcctgcagagctggaagcacctggaggatggggcaaggacggagacagcagaggaactgagagcacttgctaagaagctggagcaggagctggaccggctcacccagcaccaccggcacctgccgcagaaggcgagccagacctgttccagctcccggggcagggctgttcgaggatcccgtgtggttaaaccagaagggtctcgctcacctctcccctggcctgttgtggagcaccagcctaggctgggccctggcgtggcactgaggacaccaaagaggacagtctctgccccaaggatgcttggccaccagccagccccaccagcaccagcaagaaaggggagacaggccccgggaagacaccgacaatgagaagagttggtcaccctgtcaccactgaaccttgatttaacagaggcaaaatgcaagtcttccctgaagaatactgggggtagggaaacttctagtggcaatgataaaaccagcagcaatgataatagaaggcaaa

SEQ ID NO: 108235 - DNA, 1438 bp, Homo sapiens
  Payload ID: 1272
  Gene Symbol: APOL5
  Gene Name: apolipoprotein L, 5
  ENST ID: ENST00000617827
  CDS Start-End: 1-1302
atgccatgtggcaaacaaggaaatttgcaagttcccggttccaaggtgttacctggcttgggagaaggttgtaaagaaatgtggcttcgaaaggtaatctacggaggtgaggtctgggggaagtccccagaacctgagttcccctcactcgtgaacctgtgccagagttggaaaattaacaatttgatgtcaactgtccacagtgatgaggctggtatgctgtcctactttctgtttgaagagctgatgcgatgtgacaaagattccatgccagatggaaatctgtcagaggaggaaaaattgtttctctcatattttcctttgcacaagtttgagctagaacagaacatcaaagaacttaacacccttgcggaccaagttgacaccactcacgagttgcttaccaagaccagcctggtggccagctcttccggggctgtttctggggtcatgaacatcctgggtttggccctagcacctgtgacagcaggaggcagtctcatgctctcagcaactgggacagggttgggggcagcagctgccatcaccaacatagtaacaaatgtcttagaaaatagaagcaattcagcagcaagagacaaagccagccgactggggcctctgacaacatcacatgaggctttcggaggaataaattggtctgaaatcgaggctgctggcttttgtgttaataagtgtgtaaaagctatccagggcatcaaggatcttcatgcctaccagatggccaaatccaactctggcttcatggctatggtcaagaattttgtggccaagagacacatccctttctggatggctagaggggtgcagagagcctttgagggcacaactctggccatgaccaatggtgcctgggtgatgggtgctgctggggctggcttcttacttatgaaagacatgagcagcttcctgcagagctggaagcacctggaggatggggcaaggacggagacagcagaggaactgagagcacttgctaagaagctggagcaggagctggaccggctcacccagcaccaccggcacctgccgcagaaggcgagccagacctgttccagctcccggggcagggctgttcgaggatcccgtgtggttaaaccagaagggtctcgctcacctctcccctggcctgttgtggagcaccagcctaggctgggccctggcgtggcactgaggacaccaaagaggacagtctgtgccccaaggatgcttggccaccagccagccccaccagcaccagcaagaaaggggagacaggccccgggaagacaccgacaatgagaagagttggtcaccctgtcaccactgaaccttgatttaacagaggcaaaatgcaagtcttccctgaagaatactgggggtagggaaacttctagtggcaatgataaaaccagcagcaatgataatagaaggcaaa

SEQ ID NO: 108236 - DNA, 10121 bp, Homo sapiens
  Payload ID: 1273
  Gene Symbol: APOL6
  Gene Name: apolipoprotein L, 6
  Uniprot ID: Q9BWW8
  ENST ID: ENST00000409652
  CDS Start-End: 277-1308
gaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctggggtcaccagcatcgtgagtggtacgttggaacgctccaaaaataaagaagcccaagcacgggcggaagacatactgcccacctacgaccaagaggacagggaggatgaggaagagaaggcagactatgtcacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggaacaacactggcgatgaccaaaaatgctcgcgtgctgggaggtgtgatgtccgccttctcccttggctatgacttggccactctctcaaaggaatggaagcacctgaaggaaggagcaaggacaaagtttgcggaagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggctgtgtgtgtgtctgtgtgtctgtgtgtatgtacagtttacatgaatgttcctcaggacatggcatacaatggccttggaggtccaaataatatcaagtacatcttggagatgagggtgcctgtcctggacagacctcggcatgccttctgtttctccttcaatgctccttaaggcctatgtgctgggaaaagggtcttccctgtttgtttgtttgtttgtttgtttgtttgttttgagacagggtctctgttgcccaggctggagtgcagtggcgtaatctcggctcactgcaacctctgcctcctgagtgcaagcaagtctcctgcctcagcctcccaagtagctgggattacaggcacgcaccaccacgcccagctaattttggtatttttttgtagagacagggtttcaccattttggccaggctggtctcgaattcctgacctcaagtgatccacccaccttggcctcccaaaatgctgggattacaagcgtgagctaccctgcccagccgggtcttcccagttttaacaaagaggtcacagagccacaggcggagttaggaactaaattgtctcctcctcccaattcatatgttgaagtcctaaaccaaaatgtggctgtatttagagatggaccctttgggaggtaattagggttgactgaggccatagggtgaggtcctaacccgatggaattgacttctttataagaggaggaggaaatacaagagggcctccccacccctgctgcacacctacactgaaggaaggctatttgcagatgcagcaagaaggcagccatctgcaaggcagaagaagagagccctcaccaggaactgaataagtcagtcagtctgggacttccagcctctagaactgtgaaacaataaatttctgtggtgtaagcaactcaatctatagtagtttgttactattttgttatagcaaccaaagatgactaagccagacaggttatgtcactcgccaagtgtcttagtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgtcttgctgtgttctcacatggcagaaggggcaaacaagcccccctgggcctcttttataaaggcactaactctatgcctaaaggcagggccctcatgactctatcacctaccaaaaggctccacttctttatactattggaggggtagaaggaacttcctttctagaccttgaaggtttaagaatttgaatctataaaacaagctgacaatagacagattaacaggagaaaaagcatatacattttttaatgtgggccagatggcagaagcttaaataacaccccaagctacaggaagtgaggcctctgatggggaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtaatcctatctactcgggaggctgaggcaggagaatcgcttgaacccaggctgtaaaggttgcagtgagccaagatcatgccactgcactccagtctgggtgtcagaatgagaccccatctcaaaaaaaaaaaaaaaaaaaaaaaagaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaaggaaagtaaaaatatggcataaaagataagaattggctctcctgtacagggcacttactacgaatggagcttgcagggctgagagttgctccagatgagtcagtgagtggtgaatgaatgtgaaggcctagggcattactgtatactactgtaggctttataaacacagcacacttagggtacacaaaatgcatattaaaacattttcttccttcagtatattaggcaataggaatttttcaagtccactataaatcttatcaaaccatggttgtatatgcagttgaccgaaacattgttattggacacataactatagttgaaagaataagcaaaaagtctatctaggtgtgctgtcttgagcaacttttaattattctcctgtcctgcaatatgagttaatcttctctgatcgatgtagattccaggaaggggtgtccaggacaattaccttccttctggagaaacttcccttaatcaaataagagaacttcaaagaaaatccctccctgtgctttggaagggaagggaggtgggcagcagtgggtcagagatagacctttgttctcttatttctgaggcccttcagtctcctttattcaaagcactcagcatgccaaagcaccctattttagggtatctttttctgagccctaaacactgtgttggggatgtcaactgtgacaggaaaatatcttggggccccagaatcactaaggaaaactcaagcttagggaaacttcttagggcaaacccacctcccactctattcaaagttatctctctgctcactgagatagatacatatctgattgcctcctttggaaaggctaatcagaaactcaaaagaatgcaactgtttgtgtctcacctatctgtgacctggaagctccctccccactgaaccaatgttcttcttacatatattgattaatgtcttatgtctccctaaaatgtataaaaccaaggtatgccccaaccatcttggccacatgtcatcaggacttcctgagtctgtgtcacagtgtgtcctcaaccttggcaaaataaactttctaaattaactgagacctgtctcggattttctgggttcacattttggaaaccatgaatggattctgggtggagatgcccctgacccttgacaaatctatcggtgcttggtaccagcatgagctaactttatggctcaaaccaataggacaatttgctgaggtctgagaggactccctccagaaaatccctgatctcttaaaatttggtagagatcggaagtttattttgctgtacaacacctctttttttggagttttacttgctcccaacaaggaaggcaagttttcctgctttcatgatgatggaaggcaggtgatgtttttatggagtttcagctttcttccaatgcacttagagcactcagaaattgtataatttgtgtgaccattgttagttttgcttaactgttttgttgtttgtttctgtcttagtcaaatctgaaggggaaccctaaattacggggtcaaggactctgaagtggtaggaaaacagccagcttaaaaaactttttttaaattttaattactataggggctttatttacataacacagccagctttttgctagccagaccaaactcaaagagcaatggctgtacttctgaaatagcaacactttgtcctagctgagatttggtaataagattttttttttaagtttttaaagaagctcagtggttgaaagtctgcttaactgaaacagtaacatccatgatgtgtgttttgtgcatgtttgtatttgaaaggccttcatgtttttgtttcttgtttgtttttctctcctaagaccttgtcttttttttgtagcaaaagttttttttttttttttccttttacttctcagttgactgaattctgttttcaccggattttttgactaaaatagctattgcaacagaggctactcttgggttaaggaagaatgtagtttcgttttatgtttaatatcgctcaaagaaaaataaaagcatctccctctaacaccaccagacttttcctctctgtaccttatcatgtaaattttgctatttgattttcacctgggttgtttcctttaatgtgcaaaaatttaaggctatttagctgacaactgcctagggttgtaaaacaggttatcaagaatctgaaagtctaagataggaaaaaaaagtgggggggcattataaatctataaaatgtacttctattggcatgcctaatacgtctttatatgtatgtatgtgttgtgtacacgatgttttagtgctaaaaatatgtaaaagagctctacttggcttaaagaaaaataaaagtgcttaaatcagatactaaaaaagaaaaggctagtcaaatgctttttcaaatttatgtaacttaagtaaaatctttaataaataaagtagctttaaaattattggtaaagtagtattagaaatgtcttaagaattgccagcatacatttttgtttgcattatattaatcaaacagttttatacttatccctgccaaataccagaaggtgtcaaaatttggcataggggttataaaactataaacccagcccaaaacagaatgatctttgcttgtgtaatttttaataaataagacattgatatgggtttaatgaaaacagctgcatcttgaatttagtaagattaccataacttctaatcctgtggctttaggcagtttagtccacagacaataaggaggtttgttttgggaaaggactgttattgtcattgtttcgaagctgaacttaaactaggttcctcccaaagttcattcggcctatgcccaggaatgaacaaggacagcttggaagttaagagcaaggtggagtcagttaggtcaaatcgtttttcactgtctcagttgtaattttgcaatggaagtttcataactttaaatcatgactatcacagtttttataaataatctaggtaaacaattaataaaataactaggtaaatgtaatgggataaatacttatagaccaactggacataatttagaatataaagtcatattaaattaaataatagataatttattatttgggtattttccaataaatatatcttgtaggaaaacattgttgcttaaaaaaaagtgtgtccttttttaaaaaaatggtgaacaagttttgtctaattcaaagcttattaaaaggttatatataaaacaaggtaaaaggaaccagaaaagaaaaaaaatgtaaataaagttataaaaataaagaattttttcaaggttaaaaagctgaaaaagaaataattttatataagaaagaattttatatggtaaatttagtcctaaaataaaataactggttgtttaacaaggagggatgttcaggacaaaccagaaagtccaagcatgtcatgaacattggtgtaagtcatgataagattttatatatatatatacacacacacacacacaccccaaaagcttttatataatcaagttgtcatattattattaagttttggtttgcttagggaagaaagagctaatttttaaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaactgcattcctgaggcactaggcaagaaattaaagctattcaactcctcaaggcccagggactattgcggaagaggtgggcgcgtaagattgtaagggccgattttgaaagatccagtaagttcagtttctctatgaactaatcattcaagtcaaaggcacactgatgcaaaatcagtatatggacccctgtgtctgattagcaaggttttcttgaagcattaaccaactccttcataaaggttataaaaggcttatggaagttatattttataatcaagattaaatcttatagtttgtttacaaaattttgaaaatcaaatgtgattggcttcaggctgtttttattagggcttcttgtttagaaagttaagtcacctctctcaaagaatgaaggtttttgctttttttgaaatccttgaattatcacttggattaaataaatgactttacgatgacctgtaattttattttgtaatgtcaagtgttttaaaccttttgtatttgacaagctttccaaaatcaaattataaattatgtatttttctaacctaattaatcctttaagatcttagtttccctaaagtcctaaaatgacataatttggcttatttggtataaaaattatataggaagcattgtcaaatgtgaaatggtgtttggttttctttgggctgtatttgtataaatatgttattggtgtatgttccaaaattatgtgaaactcctataattctaatataacttagtgtacattatcagtaataatcataattgttatattaaaattattgtgtgccacagaggtaaaaaatttccttgtcagttttgtcttttgactatggctgccttaaaacttttttcttccatgcacaattgttgttttggtcctcttttttaaatatatttttattattatttttgagatggggactcactctgttgcccaggctggagtgcagcggcacgatcttggctcactgcaactgccacctcccaggttcaagcggttctcctgcctcagcctcccgagtagctgggattacaggcatacaccaccatgcccagctaatttttttgtattttcagtagagatggggtttcaccatgttggccaggctggtcttgaactcctgacctcaggtgatcagcccaccttggcctctcaaagtgctgaaattacagatgtgagccacacacctggcctattttggtcctctttagaaggtggttttataatcagctgtaaaactccaacaggtgctcttacatgcaggtttctgataactttggagattgtgacatcagaatagagggaaaagtttcaggactcatggagagctaaaatgttcatgagtatcaagcagaacaggaattaactgcatagactgaaccaatctttttgactttttgcttaaaatgtttgctgatcctttgttttgtgtttcagtcttaaaacttttcttttgagctattgacagcttttaacaatttagtatactcctatgacaaaatttggagcatatttgtttctctctacctgatttctccagaattcagaaactatttgtaagtattcttaacttatggtgatacagttatttgcataagtgcaataagaatctgttctaatttgtaacaggacacgattggagaaattggttgttttactaagactttgactggaatggtgtgcttttctttaaggaatcaaacttgacttatggaaccaataaagtccttggaaaaactggccccatattttgtgtacacagtctccgtacaagatttctgacctgtagtaagtaaagaatgtcactttctgacaggcacataagccccaggtttacctcagaacctcaagaggagaggaaattcacccaatttataagtatttgatggcacaaatccatggctgggcatggctttaagaaagtcttatctgagattcctcctgtggaacaaagttaattggttccagagattcaaagccagagttgctgtcagttcattggtagagatgccatcactgggcaagtgttctgaaaacatcttatctgaataacagcagtcctggagaacatctagggatctagcaaagcgagagatacatgaaggacataaaaacgtttttagaaagtccttggaaacagttctcatttcagacatgtaagcatgagctaggatgaaaagtgatttcatcctggtatctgcaattttcacattcattaggtttcaacatataaactttcaggggacacagacattcagactatagcaccaagctgtagaagctacatagttgtagaccagggtcagcaacccaagaagcctgacttccaagctgtgcttttaacttccccaccatgttgcacctaaagctttggagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatttgattgatctctcatgtctccctaaaatgtataaaaccacgctgttccccgaccacctggagcacatgttctcagggtctcctgagggctgtgtcacaggccatgttcacttacatttggctcagaataaatctcttcaaatatttta

SEQ ID NO: 108237 - DNA, 1184 bp, Homo sapiens
  Payload ID: 1274
  Gene Symbol: APOM
  Gene Name: apolipoprotein M
  Uniprot ID: O95445
  ENST ID: ENST00000375916
  CDS Start-End: 497-1063
cacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 108238 - DNA, 922 bp, Homo sapiens
  Payload ID: 1274
  Gene Symbol: APOM
  Gene Name: apolipoprotein M
  ENST ID: ENST00000375918
  CDS Start-End: 239-628
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaa

SEQ ID NO: 108239 - DNA, 709 bp, Homo sapiens
  Payload ID: 1274
  Gene Symbol: APOM
  Gene Name: apolipoprotein M
  Uniprot ID: O95445
  ENST ID: ENST00000375920
  CDS Start-End: 238-588
cccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 108240 - DNA, 761 bp, Homo sapiens
  Payload ID: 1274
  Gene Symbol: APOM
  Gene Name: apolipoprotein M
  Uniprot ID: O95445
  ENST ID: ENST00000383438
  CDS Start-End: 74-640
agagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 108241 - DNA, 709 bp, Homo sapiens; identical to SEQ ID NO: 108239
  Payload ID: 1274
  Gene Symbol: APOM
  Gene Name: apolipoprotein M
  Uniprot ID: O95445
  ENST ID: ENST00000400157
  CDS Start-End: 238-588

SEQ ID NO: 108242 - DNA, 761 bp, Homo sapiens; identical to SEQ ID NO: 108240
  Payload ID: 1274
  Gene Symbol: APOM
  Gene Name: apolipoprotein M
  Uniprot ID: O95445
  ENST ID: ENST00000432598
  CDS Start-End: 74-640

SEQ ID NO: 108243 - DNA, 709 bp, Homo sapiens; identical to SEQ ID NO: 108239
  Payload ID: 1274
  Gene Symbol: APOM
  Gene Name: apolipoprotein M
  Uniprot ID: O95445
  ENST ID: ENST00000422771
  CDS Start-End: 238-588

SEQ ID NO: 108244 - DNA, 922 bp, Homo sapiens; identical to SEQ ID NO: 108238
  Payload ID: 1274
  Gene Symbol: APOM
  Gene Name: apolipoprotein M
  ENST ID: ENST00000452949
  CDS Start-End: 239-628

SEQ ID NO: 108245 - DNA, 709 bp, Homo sapiens; identical to SEQ ID NO: 108239
  Payload ID: 1274
  Gene Symbol: APOM
  Gene Name: apolipoprotein M
  Uniprot ID: O95445
  ENST ID: ENST00000416324
  CDS Start-End: 238-588

SEQ ID NO: 108246 - DNA, 761 bp, Homo sapiens; identical to SEQ ID NO: 108240
  Payload ID: 1274
  Gene Symbol: APOM
  Gene Name: apolipoprotein M
  Uniprot ID: O95445
  ENST ID: ENST00000436931
  CDS Start-End: 74-640

SEQ ID NO: 108247 - DNA, 922 bp, Homo sapiens; identical to SEQ ID NO: 108238
  Payload ID: 1274
  Gene Symbol: APOM
  Gene Name: apolipoprotein M
  ENST ID: ENST00000419996
  CDS Start-End: 239-628

SEQ ID NO: 108248 - DNA, 911 bp, Homo sapiens
  Payload ID: 1274
  Gene Symbol: APOM
  Gene Name: apolipoprotein M
  ENST ID: ENST00000430238
  CDS Start-End: 239-628
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaaggtaaggggttaaaatctcataaaacaggattaggactcaccaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgt

SEQ ID NO: 108249 - DNA, 761 bp, Homo sapiens; identical to SEQ ID NO: 108240
  Payload ID: 1274
  Gene Symbol: APOM
  Gene Name: apolipoprotein M
  Uniprot ID: O95445
  ENST ID: ENST00000441436
  CDS Start-End: 74-640

SEQ ID NO: 108250 - DNA, 761 bp, Homo sapiens; identical to SEQ ID NO: 108240
  Payload ID: 1274
  Gene Symbol: APOM
  Gene Name: apolipoprotein M
  Uniprot ID: O95445
  ENST ID: ENST00000430282
  CDS Start-End: 74-640

SEQ ID NO: 108251 - DNA, 710 bp, Homo sapiens
  Payload ID: 1274
  Gene Symbol: APOM
  Gene Name: apolipoprotein M
  Uniprot ID: O95445
  ENST ID: ENST00000425177
  CDS Start-End: 239-589
ccccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctca

SEQ ID NO: 108252 - DNA, 761 bp, Homo sapiens; identical to SEQ ID NO: 108240
  Payload ID: 1274
  Gene Symbol: APOM
  Gene Name: apolipoprotein M
  Uniprot ID: O95445
  ENST ID: ENST00000426800
  CDS Start-End: 74-640

SEQ ID NO: 108253 - DNA, 922 bp, Homo sapiens; identical to SEQ ID NO: 108238
  Payload ID: 1274
  Gene Symbol: APOM
  Gene Name: apolipoprotein M
  ENST ID: ENST00000426401
  CDS Start-End: 239-628

SEQ ID NO: 108254 - DNA, 922 bp, Homo sapiens; identical to SEQ ID NO: 108238
  Payload ID: 1274
  Gene Symbol: APOM
  Gene Name: apolipoprotein M
  ENST ID: ENST00000440956
  CDS Start-End: 239-628

SEQ ID NO: 108255 - DNA, 709 bp, Homo sapiens; identical to SEQ ID NO: 108239
  Payload ID: 1274
  Gene Symbol: APOM
  Gene Name: apolipoprotein M
  Uniprot ID: O95445
  ENST ID: ENST00000439902
  CDS Start-End: 238-588

SEQ ID NO: 108256 - DNA, 922 bp, Homo sapiens; identical to SEQ ID NO: 108238
  Payload ID: 1274
  Gene Symbol: APOM
  Gene Name: apolipoprotein M
  ENST ID: ENST00000425856
  CDS Start-End: 239-628

SEQ ID NO: 108257 - DNA, 709 bp, Homo sapiens; identical to SEQ ID NO: 108239
  Payload ID: 1274
  Gene Symbol: APOM
  Gene Name: apolipoprotein M
  Uniprot ID: O95445
  ENST ID: ENST00000443975
  CDS Start-End: 238-588

SEQ ID NO: 108258 - DNA, 1118 bp, Homo sapiens
  Payload ID: 1275
  Gene Symbol: APOO
  Gene Name: apolipoprotein O
  Uniprot ID: Q9BUR5
  ENST ID: ENST00000379226
  CDS Start-End: 233-829
gcgttcacccgctgcccgggcgcgacgcgctgcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaa

SEQ ID NO: 108259 - DNA, 714 bp, Homo sapiens
  Payload ID: 1275
  Gene Symbol: APOO
  Gene Name: apolipoprotein O
  ENST ID: ENST00000439528
  CDS Start-End: 1-537
gtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagtta

SEQ ID NO: 108260 - DNA, 916 bp, Homo sapiens
  Payload ID: 1275
  Gene Symbol: APOO
  Gene Name: apolipoprotein O
  ENST ID: ENST00000490078
  CDS Start-End: 202-546
gcggctcagcgacgcggcttctagaaccgggtgattgaactaaaccttcgccgcaccgagtttgcagtacggccgtcacccgcaccgctgcctgcttgcggttggagaaatcaaggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaa

SEQ ID NO: 108261 - DNA, 461 bp, Homo sapiens
  Payload ID: 1275
  Gene Symbol: APOO
  Gene Name: apolipoprotein O
  ENST ID: ENST00000634086
  CDS Start-End: 1-272
gattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaa

SEQ ID NO: 108262 - DNA, 1159 bp, Homo sapiens
  Payload ID: 1275
  Gene Symbol: APOO
  Gene Name: apolipoprotein O
  ENST ID: ENST00000633372
  CDS Start-End: 917-1159
agcttcgtggcttcacacatgctgattcctctgtctataatgtcctatacttgttttgtctttctgtagaactgcctaagagccgggagaattcatgcttttgaaacaaggggaatttcccttgtccctcttacagggcatgtgatgggagtgtggcccacttcttaggtgccccactgctcaaaacccctagggaaagcaggcagatgggcaggtcgtggggagtgtgggctccaaccccatggcagcgtctaggggtggatgtttacagcttctgcagccccagtgggcgtgtgttacgtgtgctcttttagttttgctgtcagtaggcagcttgtgttcatcagctcagttagaccctctgccttattgcaaggacagagggctttctgtatcctagggttcttgcctgagtataccagaaaaaccggatcacacgtgggcttggaggatgagtgcaaggttttattgaatggtggaagtagcactcagcagatggaaacggagccagaaggggtatggagtgggaaggtggttttcccctggagtcaggccgcttagcagccaggctctcctctgaccgccctcagccaaactccgcgttgtcctgccgttctgctgttggtggcctgccggagtctgtcactgtgttcttctgctggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactgg

SEQ ID NO: 108263 - DNA, 437 bp, Homo sapiens
  Payload ID: 1275
  Gene Symbol: APOO
  Gene Name: apolipoprotein O
  ENST ID: ENST00000633432
  CDS Start-End: 1-148
tggactccttttggctagaggttcaaaaataaagaagctagtgtatccgcctggtttcatgggattagctgcctccctctattatccacaacaagccatcgtgtttgcccagccaggaaatgtgaagaattcacctggaactaagtagaaaactccatgctctgccatcttaatcagttataggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaa

SEQ ID NO: 108264 - DNA, 1279 bp, Homo sapiens
  Payload ID: 1276
  Gene Symbol: APOOL
  Gene Name: apolipoprotein O-like
  Uniprot ID: Q6UXV4
  ENST ID: ENST00000373173
  CDS Start-End: 88-894
gtggggctgtcctaagggaagcctagtcgaactgatttgtccctctctgctctccgtctgaaaaccttggccgaaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgt

SEQ ID NO: 108265 - DNA, 6466 bp, Homo sapiens
  Payload ID: 1276
  Gene Symbol: APOOL
  Gene Name: apolipoprotein O-like
  ENST ID: ENST00000622540
  CDS Start-End: 37-828
ttggccgaaagggttgtagacatggcggccatcaggatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaggtatatgctacaagccagcaaatttttggagcagttaaatcattgtggacaaaaagcagcaaagaagagtcactccctaaacctaaagaaaaaactaaggctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgtataaatacatatacatatatgtataaatacatatacatatttatacatatatgtataaatacatacatatttatacatatatgtataaatacatacatatttatacatatatgtataaatacatacatatttatacatatatatgtataaatacatacatatttatacatataaacatatatttctgctctagctttcccagattaatgctagttaaattagaatggtgtatggaaaggtgtgtttccctctgtttttttttttttttttttttttttttttcccatttcctagagctggaataaaatatccatgttttatgggacttgagcttggctttgtcccttggttttgttaatgttaattcctcttaaatatctaaaaacatctctacctatttgagagggccatatgctacacaggcttcctaatactgcttagcaatccttctactggttcctaagtggtttactattgtgttccctggaagaggtattacaaacgttttattcttctcaagcctcttagaactgtcaaagttgactgtgcctcctatttcatagagaaaaaactaaattattagatatgaccattcccaaaacttcttcccatctaccttcaagacttacctcttttcagccatgcatcccccttttctaagacatgcttctctttgtgttcttgacctcattccttcccatctaagaccatattccaccctgtttaatttctagtcttcggtttctctttttacagtgagcaaattagaagaataggttagaagaatagggtagtagatactgtagtttctttcctccacctctacatagctgcaggtcttctctgtcttaaatcaacaataacaaaacaagacaaaaacctttccttaacttggcctcttcccttgaactattttttctctctccttcctataattgttatacttctttaaaaagtaattgttactttttgacaaaagtaaatattgtcccttttttccctactttcaagtcctctctgtcttgtgacattctggcctccatacctgcttaattttttttgagatggggtcttgctctgttgcccaggctggagtgcagtggcacaaacacagctcactgcaacctccacctcccaggatcaagcaatcctcccatctcaccctcccaagtagctgggactataggcacccgccaccatgcctaattttttgtatttttggtagtgacagggtttcaccatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcacctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaagaacaaaactcagtctcaaaaaataaataataaaaaataaaggtatataatatgtcttagatttgatgaaatatgagtgtgtttgagatctgatccaaggttttaaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctagtttttcataagtaagctcttcagaatttatctccagtatttgaaatgaatttttttaaacctcagatctgaatatattcaaacacccatatttcatcaaatctaaggcatatcatatacctttaatttaaaaaaaaatgctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctgt

SEQ ID NO: 108266 - DNA, 6445 bp, Homo sapiens
  Payload ID: 1276
  Gene Symbol: APOOL
  Gene Name: apolipoprotein O-like
  ENST ID: ENST00000613473
  CDS Start-End: 1-807
atgtctgagattaaaatgggaaaactgacaaccatgcctgcaggtctgatatatgcatctgtaagtgtacatgcagccaaacaagaggaatccaaaaagcagctagtgaaaccagagcagctccccatatatactgcaccaccgctccagtctaaatatgttgaagagcagcctggtcatttacaaatgggctttgcttccatccgcactgcaactggttgttacattggctggtgcaagggtgtttatgtctttgtgaaaaatgggataatggatacagtacaatttggaaaagatgcttatgtctatctgaagaatcctcctcgagattttcttccgaaaatgggagttattacagtttcaggattggcgggcttggtttcagcgagaaaaggttccaagtttaagaaaattacttatcctctgggactggccactttaggagcaactgtttgctacccagttcagtccgtaataattgctaaggtaacagcaaaaaaggtatatgctacaagccagcaaatttttggagcagttaaatcattgtggacaaaaagcagcaaagaagagtcactccctaaacctaaagaaaaaactaagctaggatcctcttccgaaatagaagtacctgcaaaaacaactcacgtcttgaaacactcagtgcccttgccaacagaactcagctctgaagcaaagaccaaatcagaatccacttcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgtataaatacatatacatatatgtataaatacatatacatatttatacatatatgtataaatacatacatatttatacatatatgtataaatacatacatatttatacatatatgtataaatacatacatatttatacatatatatgtataaatacatacatatttatacatataaacatatatttctgctctagctttcccagattaatgctagttaaattagaatggtgtatggaaaggtgtgtttccctctgtttttttttttttttttttttttttttttcccatttcctagagctggaataaaatatccatgttttatgggacttgagcttggctttgtcccttggttttgttaatgttaattcctcttaaatatctaaaaacatctctacctatttgagagggccatatgctacacaggcttcctaatactgcttagcaatccttctactggttcctaagtggtttactattgtgttccctggaagaggtattacaaacgttttattcttctcaagcctcttagaactgtcaaagttgactgtgcctcctatttcatagagaaaaaactaaattattagatatgaccattcccaaaacttcttcccatctaccttcaagacttacctcttttcagccatgcatcccccttttctaagacatgcttctctttgtgttcttgacctcattccttcccatctaagaccatattccaccctgtttaatttctagtcttcggtttctctttttacagtgagcaaattagaagaataggttagaagaatagggtagtagatactgtagtttctttcctccacctctacatagctgcaggtcttctctgtcttaaatcaacaataacaaaacaagacaaaaacctttccttaacttggcctcttcccttgaactattttttctctctccttcctataattgttatacttctttaaaaagtaattgttactttttgacaaaagtaaatattgtcccttttttccctactttcaagtcctctctgtcttgtgacattctggcctccatacctgcttaattttttttgagatggggtcttgctctgttgcccaggctggagtgcagtggcacaaacacagctcactgcaacctccacctcccaggatcaagcaatcctcccatctcaccctcccaagtagctgggactataggcacccgccaccatgcctaattttttgtatttttggtagtgacagggtttcaccatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcacctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaagaacaaaactcagtctcaaaaaataaataataaaaaataaaggtatataatatgtcttagatttgatgaaatatgagtgtgtttgagatctgatccaaggttttaaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctagtttttcataagtaagctcttcagaatttatctccagtatttgaaatgaatttttttaaacctcagatctgaatatattcaaacacccatatttcatcaaatctaaggcatatcatatacctttaatttaaaaaaaaatgctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctgt

SEQ ID NO: 108267 - DNA, 2523 bp, Homo sapiens
  Payload ID: 1277
  Gene Symbol: APOPT1
  Gene Name: apoptogenic 1, mitochondrial
  Uniprot ID: Q96IL0
  ENST ID: ENST00000409074
  CDS Start-End: 2-622
aatgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctcaaaaaaaaaaaaaaaa

SEQ ID NO: 108268 - DNA, 575 bp, Homo sapiens
  Payload ID: 1277
  Gene Symbol: APOPT1
  Gene Name: apoptogenic 1, mitochondrial
  ENST ID: ENST00000440963
  CDS Start-End: 1-357
gctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtg

SEQ ID NO: 108269 - DNA, 782 bp, Homo sapiens
  Payload ID: 1277
  Gene Symbol: APOPT1
  Gene Name: apoptogenic 1, mitochondrial
  ENST ID: ENST00000458117
  CDS Start-End: 1-362
cgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactggg

SEQ ID NO: 108270 - DNA, 333 bp, Homo sapiens
  Payload ID: 1277
  Gene Symbol: APOPT1
  Gene Name: apoptogenic 1, mitochondrial
  ENST ID: ENST00000555660
  CDS Start-End: 1-172
attaagacaagaaacacaagaatggaatcaacagttctgggcaaaccagaatttgacttttagtaagatggagtctcactctgtcacccaggctggagtgcagtggcacgatctcggctcactgcaaactctgcctcctggttcaagcgattctcctgcctcagccttctgagtagctgggactacaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccct

SEQ ID NO: 108271 - DNA, 653 bp, Homo sapiens
  Payload ID: 1277
  Gene Symbol: APOPT1
  Gene Name: apoptogenic 1, mitochondrial
  ENST ID: ENST00000495778
  CDS Start-End: 1-327
ctcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcaccccca

SEQ ID NO: 108272 - DNA, 770 bp, Homo sapiens
  Payload ID: 1277
  Gene Symbol: APOPT1
  Gene Name: apoptogenic 1, mitochondrial
  ENST ID: ENST00000489117
  CDS Start-End: 1-219
gccttcgcctgccgcggctgtcaactcgctccggagcgcggcgccgagcgcagggatacggcgcccagcgggccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgag

SEQ ID NO: 108273 - DNA, 783 bp, Homo sapiens
  Payload ID: 1277
  Gene Symbol: APOPT1
  Gene Name: apoptogenic 1, mitochondrial
  ENST ID: ENST00000556253
  CDS Start-End: 16-549
agggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcagaccccactttacctcgggtaactgaaaccatggaaagaaaaaccatggatggaggggacagctgtgctgccgccatctcccttacacagtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaa

SEQ ID NO: 108274 - DNA, 757 bp, Homo sapiens
  Payload ID: 1277
  Gene Symbol: APOPT1
  Gene Name: apoptogenic 1, mitochondrial
  ENST ID: ENST00000476323
  CDS Start-End: 301-531
gactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacaggctggatacggtggctcgcacctggaatcccatgactttgggaggccaagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactg

SEQ ID NO: 108275 - DNA, 906 bp, Homo sapiens
  Payload ID: 1277
  Gene Symbol: APOPT1
  Gene Name: apoptogenic 1, mitochondrial
  ENST ID: ENST00000477116
  CDS Start-End: 499-666
aagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgg

SEQ ID NO: 108276 - DNA, 429 bp, Homo sapiens
  Payload ID: 1277
  Gene Symbol: APOPT1
  Gene Name: apoptogenic 1, mitochondrial
  ENST ID: ENST00000554876
  CDS Start-End: 1-399
ggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcagatggagtctcactctgtcacccaggctggagtgcagtggcacgatctcggctcactgcaaactctgcctcctggttcaagcgattctcctgcctcagccttctgagtagctgggactacaggtcagaaagcaacattgaatgcagaagaaatggcggacttctacaaggaatttttaagtaaaaattttcagaagcacatgtattataacag

SEQ ID NO: 108277 - DNA, 739 bp, Homo sapiens
  Payload ID: 1277
  Gene Symbol: APOPT1
  Gene Name: apoptogenic 1, mitochondrial
  ENST ID: ENST00000473127
  CDS Start-End: 418-585
cggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctgg

SEQ ID NO: 108278 - DNA, 513 bp, Homo sapiens
  Payload ID: 1277
  Gene Symbol: APOPT1
  Gene Name: apoptogenic 1, mitochondrial
  ENST ID: ENST00000492189
  CDS Start-End: 243-410
ggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggcaagtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagcccc

SEQ ID NO: 108279 - DNA, 2141 bp, Homo sapiens
  Payload ID: 1278
  Gene Symbol: AATF
  Gene Name: apoptosis antagonizing transcription factor
  Uniprot ID: Q9NY61
  ENST ID: ENST00000619387
  CDS Start-End: 252-1934
aatcccttcaaccttctgcgcgcttccgccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcca

SEQ ID NO: 108280 - DNA, 502 bp, Homo sapiens
  Payload ID: 1278
  Gene Symbol: AATF
  Gene Name: apoptosis antagonizing transcription factor
  ENST ID: ENST00000616434
  CDS Start-End: 1-296
agatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggacagaactgtaccgctctctttttggccagctccaccctcccgacgaaggccacggggattgacatcgcccacctccgacacccagtgggcgccttggctggtgcggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 108281 - DNA, 648 bp, Homo sapiens
  Payload ID: 1278
  Gene Symbol: AATF
  Gene Name: apoptosis antagonizing transcription factor
  ENST ID: ENST00000613840
  CDS Start-End: 108-275
gggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagac

SEQ ID NO: 108282 - DNA, 601 bp, Homo sapiens
  Payload ID: 1278
  Gene Symbol: AATF
  Gene Name: apoptosis antagonizing transcription factor
  ENST ID: ENST00000610798
  CDS Start-End: 1-465
aggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtgagttacttttcggaaaaaatgtcaacatatattgtatatgtatctcgtctcttacattctggctgttatgtcatttttctttttcttctgatgattctgtttttaaggatcagaaaaataaacaatatttgaaggtt

SEQ ID NO: 108283 - DNA, 2141 bp, Homo sapiens; identical to SEQ ID NO: 108279
  Payload ID: 1278
  Gene Symbol: AATF
  Gene Name: apoptosis antagonizing transcription factor
  Uniprot ID: Q9NY61
  ENST ID: ENST00000620004
  CDS Start-End: 252-1934

SEQ ID NO: 108284 - DNA, 502 bp, Homo sapiens; identical to SEQ ID NO: 108280
  Payload ID: 1278
  Gene Symbol: AATF
  Gene Name: apoptosis antagonizing transcription factor
  ENST ID: ENST00000632435
  CDS Start-End: 1-296

SEQ ID NO: 108285 - DNA, 601 bp, Homo sapiens; identical to SEQ ID NO: 108282
  Payload ID: 1278
  Gene Symbol: AATF
  Gene Name: apoptosis antagonizing transcription factor
  ENST ID: ENST00000633401
  CDS Start-End: 1-465

SEQ ID NO: 108286 - DNA, 648 bp, Homo sapiens; identical to SEQ ID NO: 108281
  Payload ID: 1278
  Gene Symbol: AATF
  Gene Name: apoptosis antagonizing transcription factor
  ENST ID: ENST00000632039
  CDS Start-End: 108-275

SEQ ID NO: 108287 - DNA, 3117 bp, Homo sapiens
  Payload ID: 1279
  Gene Symbol: AEN
  Gene Name: apoptosis enhancing nuclease
  Uniprot ID: Q8WTP8
  ENST ID: ENST00000332810
  CDS Start-End: 152-1129
agtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcaatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggatacgacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagtaggggtcatctgttaccttgacaccctctgcacacagcatagccctctctctctccagggctgttggttctttcttctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgtcctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgaggctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtacagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggtgctgttatcagcggggaaatgtactatttaagatcagctttgttgtaaaaccatttgttctagaataaaactcaattggaaacgtgg

SEQ ID NO: 108288 - DNA, 895 bp, Homo sapiens
  Payload ID: 1279
  Gene Symbol: AEN
  Gene Name: apoptosis enhancing nuclease
  ENST ID: ENST00000559528
  CDS Start-End: 359-895
cgcggggcttcaggtgagatccaggaccctgcaccggggcggcggggtcgggcgggctgaggccgcgtgtcccgggtcgcaggtccccgcgcgttgtttccgccccggcctgcggcggggacgcctgaactgggctgaccctgccctaccggcccgcagaaaagcaggccgggcgccgcctgtctccagccctcgctctgctcgggggtccagggccagagggggcggcgctggtcgttgggactcggcccagctgccgcggccagcaagtgaccaacgcccgagtccttcccggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcaatgtcctctatgacaagtacatcaggcctgagatgcccatcgctgactaccgtacccgctggagtggcatcactcggcagcacatgcgcaaggctgtccccttccaggtggcccagaaa

SEQ ID NO: 108289 - DNA, 3714 bp, Homo sapiens
  Payload ID: 1280
  Gene Symbol: API5
  Gene Name: apoptosis inhibitor 5
  Uniprot ID: Q9BZZ5
  ENST ID: ENST00000378852
  CDS Start-End: 126-1640
gcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtaggatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatttt

SEQ ID NO: 108290 - DNA, 2257 bp, Homo sapiens
  Payload ID: 1280
  Gene Symbol: API5
  Gene Name: apoptosis inhibitor 5
  Uniprot ID: Q9BZZ5
  ENST ID: ENST00000455725
  CDS Start-End: 246-1787
gcagccgcgctgtgcgcggtgactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagactcatccatctcccccaactcaaaaatgaaacaaagatggagggagaacggaattgggaagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagcagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagt

SEQ ID NO: 108291 - DNA, 2009 bp, Homo sapiens
  Payload ID: 1280
  Gene Symbol: API5
  Gene Name: apoptosis inhibitor 5
  Uniprot ID: Q9BZZ5
  ENST ID: ENST00000420461
  CDS Start-End: 131-1483
gactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtg

SEQ ID NO: 108292 - DNA, 1868 bp, Homo sapiens
  Payload ID: 1280
  Gene Symbol: API5
  Gene Name: apoptosis inhibitor 5
  Uniprot ID: Q9BZZ5
  ENST ID: ENST00000531273
  CDS Start-End: 140-1714
gtgcgcggtgactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagcagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgt

SEQ ID NO: 108293 - DNA, 1760 bp, Homo sapiens
  Payload ID: 1280
  Gene Symbol: API5
  Gene Name: apoptosis inhibitor 5
  ENST ID: ENST00000534600
  CDS Start-End: 33-1565
agcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatcttcctcgagtggcagatatactaacgcaacttttgcagacagatgactctgcagaatttaacctagtgaacaatgccctattaagtatatttaaaatggatgcaaaagggactttaggtgggttgttcagccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatggtgagcgtttccgtttgggtacaaggaatatgagagattaggcagaaattgtgttatactttattttaattagtaattatatacagtgtcatggttctatccaatgacttttctgaattagcttggagaactagggctgttgaggaaatgatttatcccattcctctctcattcacccttctgggctgactgtattgaacatgcaacattaaacagtaagcacttaaagaaaaata

SEQ ID NO: 108294 - DNA, 560 bp, Homo sapiens
  Payload ID: 1280
  Gene Symbol: API5
  Gene Name: apoptosis inhibitor 5
  ENST ID: ENST00000534695
  CDS Start-End: 166-537
gtagacgtcgggggcgcagccgcgctgtgcgcggtgactggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctaagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatgg

SEQ ID NO: 108295 - DNA, 883 bp, Homo sapiens
  Payload ID: 1280
  Gene Symbol: API5
  Gene Name: apoptosis inhibitor 5
  ENST ID: ENST00000526394
  CDS Start-End: 1-883
gcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctgtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcaga

SEQ ID NO: 108296 - DNA, 5456 bp, Homo sapiens
  Payload ID: 1281
  Gene Symbol: AREL1
  Gene Name: apoptosis resistant E3 ubiquitin protein ligase 1
  Uniprot ID: O15033
  ENST ID: ENST00000356357
  CDS Start-End: 517-2988
atagcccggaagcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaataaatgtttaaaagaactaa

SEQ ID NO: 108297 - DNA, 581 bp, Homo sapiens
  Payload ID: 1281
  Gene Symbol: AREL1
  Gene Name: apoptosis resistant E3 ubiquitin protein ligase 1
  ENST ID: ENST00000555249
  CDS Start-End: 194-581
aatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcggctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggcct

SEQ ID NO: 108298 - DNA, 4855 bp, Homo sapiens
  Payload ID: 1281
  Gene Symbol: AREL1
  Gene Name: apoptosis resistant E3 ubiquitin protein ligase 1
  ENST ID: ENST00000555330
  CDS Start-End: 46-1560
ctgcagctgtgatcctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaaggtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatggtatgtaagctgagctcttcattctgtcatgagaagaggaccatgctgctatcatttatttggtcctttgaagatctcagtagctgagggagatggcacacggggctcagccctgttgggaaactggtgtggagacccttaaatccacactgtgctccaaaactccctctgctgatactccttggagacaccctctttggccctcactacttgaccagactggtacttgagtccttctcatgggtggggtgattgcctcttctcatcaggagccaggagagagggggacagataggaggtggcccataggagcagtcccgctgcacaatggtaggcataggccatggcactggactgcctctaaggactgctaaaaagaatatttttttgtggtgtcagaactggaaaaagcactttcccttcgggcatttctggaaatgattattaatccacaaagaagaactctgtaagctttttcttgaattgtagccagtgagaaaagcagatagactgaagaatatgaaggatagctgagctgtagcctccagagtggggcatgcctaggcatatggctggcttggagactactgatgcttttccctgagtttgttattggcactgaagtatggccggcttgggccactgacttccccattatgtagtctgctaaaagctggggatcctttagcattctactgaagaaaattttgtagcaaaagattagaacagtaagaatagtatgccagcaatccctgattctctctctgcttggtgttctctggcagcactaagacaaaggaacagggactaggagtttacgtgcttatcacaggtccttggcgtcaggacactagggatgaacatggaggtgatatgttacacagtaaacacctgccaacccctgtactcccctttgctccatcagttatcaggaaggagaactaaggagggaggaagcttattaggttcactgttgaatgatgattgaagagtacctgctgctgtatcttggaagatgacaacatcctttttcattactgtttgattgaaaataatttcaagattcaaaatctcattgacttcccaaatttgtgtttttaagaaggctttgctgcaagctaccattcccaatggggcagtcaactctgagaatattacaagccatctttattgccaaaaccagcaagtacacagagtcctgaaacaaggcaggactttggcaatgccttggcctcctggaagcatgtctgagccctcctgttcgcagggatcatgaggaacaagccctcctgagctgctacagttcctgcctgacctcagtctttcgcagtcatcatttgtcctttcttggcacatgggtgctgacctcactcatccttggggtccgggatccagcatcagggtctctataccccaggatcctccatgccacatggtcactgctctcctcagggaccaggacaaggtgctgctgcttgcccaaatgttttcccatgggatatgtaccggaaggtttatcaccaccctgggaaacataatgctgccccttgggcccagaaaggggtttccagctgggggcacgtggactggttctgctgtttttggcagtcgcttttctgaattctcccctccggcagccttccagagactgatcctggagattgagttgattgtcttggctagacctgtcattttaagctctagtcatagcactttttcagagcatcttaggcaccattgcaacccaaccagggaagctgcatccctgtggtggtccttaggcaccagtctttgttaaacaaaaccctttggcactattgtggttttctattctctgtctgaactctattcaaaagtatctttgctctcttgggccttttcttttactgttttgttttttttttttctaatcctgctttcatactagccagtgtggggaaaaggtacaatatgtcaaagagatgagagagtgttatttcttgggcaattttctattagtgtttcttattttggccagttcttttatttatgtccttgtgacccaggtacttggggggccagctacccttctggccttttagcgtctttgaaggagaccagacatgagtgaatacctaggagagtgtcagcatgtttctggaaaattggcagagaccaagccctgctgcagattcgtcaggccaggtgaaagggccaggcagttgcagctgatgatgtaaatattttgtacagtagataaa

SEQ ID NO: 108299 - DNA, 742 bp, Homo sapiens
  Payload ID: 1281
  Gene Symbol: AREL1
  Gene Name: apoptosis resistant E3 ubiquitin protein ligase 1
  ENST ID: ENST00000554070
  CDS Start-End: 1-270
tggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaaccagctgtgcctccctacatatgactcctatgaagaggtgcacaggatgctgcagctggccatcagcgagggttgcgagggctttggcatgctctgaccactctcctgtcatccagttggctcccatgctctctggagcttctgggcgcaagttacagacatcataaccactgatcctaacacacataaccatcagccagaagatgccgcatgctcccctgtgtctggaggattttgtcacctacaagccttgtctttacctcacctgctccctgcccatatctaccacaggccactttggcatgaaattcaatatagaaaatttggaaataagaaaaagaacaagggaaataggcaggccagagagaatgagtactcaagacacctggcccaaacattcatgaagaagacaccaagtcagaagagacttcctcctttgcatgatcctctcttcccatatgctaggagctttagtatttattgtctcattcacaacaaccctgcaagctagcagctgtggatactccgaacagaccagtgaggcagagcagcaaaagcagcctggaact

SEQ ID NO: 108300 - DNA, 874 bp, Homo sapiens
  Payload ID: 1281
  Gene Symbol: AREL1
  Gene Name: apoptosis resistant E3 ubiquitin protein ligase 1
  ENST ID: ENST00000481010
  CDS Start-End: 1-358
gtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcggaatgagaaggcttggttcctgtccagaaagtgtttgtgatgtttggctctgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattatctctttcttggacaggtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttg

SEQ ID NO: 108301 - DNA, 761 bp, Homo sapiens
  Payload ID: 1281
  Gene Symbol: AREL1
  Gene Name: apoptosis resistant E3 ubiquitin protein ligase 1
  ENST ID: ENST00000553411
  CDS Start-End: 1-246
gtggccttcactgtgcgcaaggctgggcgttatgaaatcacagtgaagcttggtggattaaatgtggcatatagtccctactacaaaatttttcaacctggaatagggtctcactatgttgcccagggtggtctcgaactcctggactcaagtaatcttcctgctttggccttccaaagtgttgggattacaggcgtgagccaagtcacacagcctgattactgtagctcttataataagtcttgaaattggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttg

SEQ ID NO: 108302 - DNA, 394 bp, Homo sapiens
  Payload ID: 1281
  Gene Symbol: AREL1
  Gene Name: apoptosis resistant E3 ubiquitin protein ligase 1
  ENST ID: ENST00000490805
  CDS Start-End: 1-394
gctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaagcaattctcagtgaaggagttctacctgaagatcatcccctggcgcctttacaccttccgagtgtgtccaggaacaaaattttcataccttggtcctgaccctgtccataagct

SEQ ID NO: 108303 - DNA, 2639 bp, Homo sapiens
  Payload ID: 1281
  Gene Symbol: AREL1
  Gene Name: apoptosis resistant E3 ubiquitin protein ligase 1
  ENST ID: ENST00000556202
  CDS Start-End: 745-2639
aaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagctgcagctgtgatcctcggctgtctgttggcattgacgggacctgatgttttacgttattgttattctataagaacgggcagcctttccctgcacatcggcctgtgggactaagagttcacatctctcatgtcgagctagcagtggaaattccagtgacccaggaagtccttcaggagcccaattccaacgtagtaaaagtggccttcactgtgcgcaaggctgggcgttatgaaatcacagtgaagcttggtggattaaatgtggcatatagtccctactacaaaatttttcaacctggaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgctaccaactgtagcagcactccatggcacctgccacccatgcacatgacctcttcccagcgccggccatccactgctgttgacgaggaagatgaagactcgccctctgagtgccacacccctgagaaggtgaagaaaccgaagaaggtgtactgctatgtgtcaccaaagcaattctcagtgaaggagttctacctgaagatcatcccctggcgcctttacaccttccgagtgtgtccaggaacaaaattttcataccttggtcctgaccctgtccataagctgctcacactggtggtggatgatggcattcaacctcctgtggagctcagctgtaaggagaggaacattctagcagccacttttatccgctccctgcataagaacataggaggctctgagacctttcaggacaaggtgaactttttccagcgagagcttcggcaggtacatatgaaaagaccacattccaaagtcaccctgaaggtcagcagacatgccttgttggaatcgtctctgaaagccactcggaatttctccatctcagattggagcaagaactttgaggttgttttccaggatgaagaagctctggactggggagggcctcgccgggaatggtttgagctaatctgcaaagcactatttgataccaccaatcagctcttcacccggttcagtgacaacaaccaagcattagtgcatcccaaccctaatcgccccgctcatctgcgcctgaaaatgtatgagtttgcgggacggctcgtgggcaagtgtctctatgagtcctctctaggaggagcctacaagcagttggtccgagctcgcttcacccgctctttcctggcccaaatcataggactgcgtatgcattacaagtactttgaaacagatgacccagaattctacaaatctaaagtttgttttatcctcaacaatgacatgagtgagatggagctggtctttgcagaagagaaatataataaatcaggtcaattggataaggttgtagaactcatgacaggtggagctcaaactccagtcaccaatgcgaataaaatcttctatttaaatttgctggcccaatatcggctggccagtcaagtgaaagaggaggtggaacatttcctaaaaggcctgaatgaattggtccctgagaaccttttggctatttttgatgagaatgagcttgagctgctgatgtgtgggactggagacatcagtgtgtctgacttcaaagcccatgcagtagttgttggtggctcatggcatttcagagaaaaggtcatgaggtggttttggactgtggtttccagtctgacccaggaggagttggctcggctacttcagttcacaacaggctcctctcagctaccacctggaggctttgccgccctctgtccctcatttcagattattgccgctccgacccatagcacgctgcctactgcacacacatgttttaacca

SEQ ID NO: 108304 - DNA, 706 bp, Homo sapiens
  Payload ID: 1281
  Gene Symbol: AREL1
  Gene Name: apoptosis resistant E3 ubiquitin protein ligase 1
  ENST ID: ENST00000553279
  CDS Start-End: 32-331
ctcggctgtctgttggcattgacgggacctgatgttttacgttattggtggaatcacagtgtctgtggttgcattcttcttcacaattaagttcctctttgagcttgccgcacgtgtagtcagcttcctccagaatgaggaccgcgagcgccgaggggaccggactatttatgactacgtgcggggaaattacctggatccccggtcttgcaaagtctcctgggattggaaggacccctatgaggtgggccacagcatggccttccgagtgcatgaatggtggttccttctaagaccaaaattgtgtgccacttttctactcttgtattgacctgtgggcagccgcacacccttcaaatagtaccccgagatgagtatgataatcccaccaacaattccatgtccttgagagatgagcacaattacaccttgtccattcatgagctcggccctcaagaagaagagagtactggtgtctcatttgagaaatcagtaacatccaacaggcagactttccaggtgttcttgcgactcaccctgcattctcgaggctgcttccatgcttgcatttcataccaaaatcagccaatcaataatggtgaatttgacattattgtcctaagtgaggatgagaagaatatcgtcgaacgcaatgtgtccacttcaggcgtgagcatttactttgaggcttatctttataatgcta

SEQ ID NO: 108305 - DNA, 1605 bp, Homo sapiens
  Payload ID: 1282
  Gene Symbol: AVEN
  Gene Name: apoptosis, caspase activation inhibitor
  Uniprot ID: Q9NQS1
  ENST ID: ENST00000306730
  CDS Start-End: 131-1219
gcaccccgcgcctcgctgctaccgggcgcctttcgctcgcggctcctccgtgcggcccgcttccggtggggccagggcgtctccgccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcca

SEQ ID NO: 108306 - DNA, 284 bp, Homo sapiens
  Payload ID: 1282
  Gene Symbol: AVEN
  Gene Name: apoptosis, caspase activation inhibitor
  ENST ID: ENST00000560649
  CDS Start-End: 1-178
ggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagatgcacctataaaagagggagataacatcttaccagatcagacgtctcaggacctgaaatccaaggaagatggggaggtggtccaagaggaagaagtttgtgcaaaaccatctgtgac

SEQ ID NO: 108307 - DNA, 5257 bp, Homo sapiens
  Payload ID: 1283
  Gene Symbol: AATK
  Gene Name: apoptosis-associated tyrosine kinase
  Uniprot ID: Q6ZMQ8
  ENST ID: ENST00000326724
  CDS Start-End: 26-4150
atgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaagaaa

SEQ ID NO: 108308 - DNA, 4938 bp, Homo sapiens
  Payload ID: 1283
  Gene Symbol: AATK
  Gene Name: apoptosis-associated tyrosine kinase
  Uniprot ID: Q6ZMQ8
  ENST ID: ENST00000374792
  CDS Start-End: 81-2720
gatgcggcggctcgggccggggccgcgggcgtcctgagcgcagcgccctcccgggatgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaag

SEQ ID NO: 108309 - DNA, 5081 bp, Homo sapiens
  Payload ID: 1283
  Gene Symbol: AATK
  Gene Name: apoptosis-associated tyrosine kinase
  ENST ID: ENST00000417379
  CDS Start-End: 168-3983
gccaccaggtgaaggtccaaggctgctggggcagatggcggtggcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaaga

SEQ ID NO: 108310 - DNA, 475 bp, Homo sapiens
  Payload ID: 1283
  Gene Symbol: AATK
  Gene Name: apoptosis-associated tyrosine kinase
  ENST ID: ENST00000575363
  CDS Start-End: 127-475
attccagcaccagtgtgcccctgggaagtcctgcctccacactgggctccctcctgggatttggggacctgcgctgggctccctggtggggagctgtgctgagggaaggggctgggcaggcccccaatgctgaccctgtgctacctgattgcacgctgtatcggcaggacccggctggcccccgggcagcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagc

SEQ ID NO: 108311 - DNA, 2108 bp, Homo sapiens
  Payload ID: 1283
  Gene Symbol: AATK
  Gene Name: apoptosis-associated tyrosine kinase
  ENST ID: ENST00000570932
  CDS Start-End: 1-318
tcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaag

SEQ ID NO: 108312 - DNA, 2260 bp, Homo sapiens
  Payload ID: 1284
  Gene Symbol: AIFM1
  Gene Name: apoptosis-inducing factor, mitochondrion-associated, 1
  Uniprot ID: O95831
  ENST ID: ENST00000287295
  CDS Start-End: 232-2073
aatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttct

SEQ ID NO: 108313 - DNA, 2248 bp, Homo sapiens
  Payload ID: 1284
  Gene Symbol: AIFM1
  Gene Name: apoptosis-inducing factor, mitochondrion-associated, 1
  Uniprot ID: O95831
  ENST ID: ENST00000319908
  CDS Start-End: 224-2053
agcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 108314 - DNA, 1200 bp, Homo sapiens
  Payload ID: 1284
  Gene Symbol: AIFM1
  Gene Name: apoptosis-inducing factor, mitochondrion-associated, 1
  Uniprot ID: O95831
  ENST ID: ENST00000346424
  CDS Start-End: 25-1005
aggtcccgaatagcggtcgccgaaatgttccggtgtggaggcctggcggcgggtgctttgaagcagaagctggtgcccttggtgcggaccgtgtgcgtccgaagcccgaggcagaggaaccggctcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 108315 - DNA, 2248 bp, Homo sapiens
  Payload ID: 1284
  Gene Symbol: AIFM1
  Gene Name: apoptosis-inducing factor, mitochondrion-associated, 1
  Uniprot ID: O95831
  ENST ID: ENST00000416073
  CDS Start-End: 9-983
tcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 108316 - DNA, 1925 bp, Homo sapiens
  Payload ID: 1284
  Gene Symbol: AIFM1
  Gene Name: apoptosis-inducing factor, mitochondrion-associated, 1
  ENST ID: ENST00000460436
  CDS Start-End: 906-1730
gcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 108317 - DNA, 723 bp, Homo sapiens
  Payload ID: 1284
  Gene Symbol: AIFM1
  Gene Name: apoptosis-inducing factor, mitochondrion-associated, 1
  ENST ID: ENST00000529877
  CDS Start-End: 104-373
gtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatttgtgcagtctcatcacctaggatccccttctagatcactagcatctacaggtgcttctgggaaagatggcagcaacctagtgtacttcttaattgtaggagcaacagtcactggggcaggagtttattatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatct

SEQ ID NO: 108318 - DNA, 2105 bp, Homo sapiens
  Payload ID: 1284
  Gene Symbol: AIFM1
  Gene Name: apoptosis-inducing factor, mitochondrion-associated, 1
  ENST ID: ENST00000527892
  CDS Start-End: 9-140
tcgccgaaatgttccggtgtggaggcctggcggcgggtgctttgaagcagaagctggtgcccttggtgcggaccgtgtgcgtccgaagcccgaggcagaggaaccggctcccaggcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 108319 - DNA, 2468 bp, Homo sapiens
  Payload ID: 1284
  Gene Symbol: AIFM1
  Gene Name: apoptosis-inducing factor, mitochondrion-associated, 1
  Uniprot ID: O95831
  ENST ID: ENST00000535724
  CDS Start-End: 232-1206
aatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaatt

SEQ ID NO: 108320 - DNA, 3243 bp, Homo sapiens
  Payload ID: 1285
  Gene Symbol: AIFM2
  Gene Name: apoptosis-inducing factor, mitochondrion-associated, 2
  Uniprot ID: Q9BRQ8
  ENST ID: ENST00000307864
  CDS Start-End: 215-1336
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaa

SEQ ID NO: 108321 - DNA, 2570 bp, Homo sapiens
  Payload ID: 1285
  Gene Symbol: AIFM2
  Gene Name: apoptosis-inducing factor, mitochondrion-associated, 2
  Uniprot ID: Q9BRQ8
  ENST ID: ENST00000373248
  CDS Start-End: 19-1140
agcagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggccaagtggaacccctgggagatgacaggacaccacctctgaccccacaggaaccctgtcggtgtgcaccagcgcatccagctctcatgtctctgagatgacatgggtgttttgtccagactgggatgacggcagctttggggcagcagaggaggcatttttcagatgttttcatcttcgaatgaacttggtgatctggatgtctgcagcaagtctcagcaatctctttatgaatcatcattattattatggttcagttcatggtctttcccagggcctgggtgctgatgcttccccactccacactcgagcctcaagtatatgtggacagccacagtacactgtgcagctggtttaggacaagtgtctattccagtggtcactgtccactgggggagggcgtgcagaggggttttctttgttaatgttcttgggtttccatgatgcaactgagaaatggtgattgtgcattatacccagtacccctgagactcctttctggcccccagattcctggacactgttgatctattgggtccagaagcctggagaaggccgggtaactgaagctggtagccagttcatgttgagaagcagaggactaggtctacactggcgccctctgcattcaggtcaagggccaaatgggaatgtgcagaaggcaaggggaatccaccctcctcactgaagccttttaagaaaaaagcatcctggagagaggtagtttctctctacagaagcattcccaagaaggaaaggagcaatgctagaatgagaataccacagctttgcaactcctaacgaatggcggaatctagagaagaggcatcaatggccaccagcatcacaccaatacagacaaccaggcacgacgcgcctcctcgggcacgagcactcgccactgaccaaggagtcttggcaaagttttcgaacctacacctcatgaaacctctagatccaaccaccaagttataaaaaagcaaagaaacatgttttatgatgccaggaggatataatcaacaaaatccggactgcatgaaaccctataggacaaatggcccagcttcctcaacaaatgaattgcaaagaaataagaaagagatgaaggaggaacctatggtataagagactcatcaaccaactgcagtgcgtggactgatttggatccgaaatcaaataaacaaattttctttctttcctttcttcctttctctctccccctccccctccttccctccctccttccttctctaccttcccttccttcctttctctctctctctccctctgcctctctctttctctctttttctttccctccctccctccctctctctctctctttttctttctttcctttcttaatttcttgacatggtctcactctgtgcactctg

SEQ ID NO: 108322 - DNA, 3247 bp, Homo sapiens
  Payload ID: 1285
  Gene Symbol: AIFM2
  Gene Name: apoptosis-inducing factor, mitochondrion-associated, 2
  Uniprot ID: Q9BRQ8
  ENST ID: ENST00000613322
  CDS Start-End: 218-1339
ggccgttcggagaccagccccagcgtgccaggaccgtttccggggcctggccggggcgttgccgcggggtcggggaccagcacgagtgctgagtcacgccccgcccgggagcgcctcgggtcagtaactcgggaagacgaccaagcgggagcgggagcgggagcgggagccggagcgagagcgcgcgggcgcggccgacagcagtgcctgatttgagatggggtcccaggtctcggtggaatcgggagctctgcacgtggtgattgtgggtgggggctttggcgggatcgcagcagccagccagctgcaggccctgaacgtccccttcatgctggtggacatgaaggactccttccaccacaatgtggctgctctccgagcctccgtggagacagggttcgccaaaaagacattcatttcttactcggtgactttcaaggacaacttccggcaggggctagtagtggggatagacctgaagaaccagatggtgctgctgcagggtggcgaggccctgcccttctctcatcttatcctggccacgggcagcactgggcccttcccgggcaagtttaatgaggtttccagccagcaggccgctatccaggcctatgaggacatggtgaggcaggtccagcgctcacggttcatcgtggtggtgggaggaggctcggctggagtggagatggcagcagagattaaaacagaatatcctgagaaagaggtcactctcattcactcccaagtggccctggctgacaaggagctcctgccctccgtccggcaggaagtgaaggagatcctcctccggaagggcgtgcagctgctgctgagtgagcgggtgagcaatctggaggagctgcctctcaatgagtatcgagagtacatcaaagtgcagacggacaaaggcacagaggtggccaccaacctggtgattctctgcaccggcatcaagatcaacagctccgcctaccgcaaagcgtttgagagcagactagccagcagtggtgctctgagagtgaacgagcacctccaggtggagggccacagcaacgtctacgccattggtgactgtgccgacgtgaggacgcccaagatggcctatcttgccggcctccacgccaacatcgccgtggccaacatcgtcaactctgtgaagcagcggcctctccaggcctacaagccgggtgcactgacgttcctcctgtccatggggagaaatgacggtgtgggccaaatcagtggcttctatgtgggccggctcatggttcggctgaccaagagccgggacctgttcgtctctacgagctggaaaaccatgaggcagtctccaccttgatggagaggccaggcgggagaactaccgcagcaggtgggcgtacggactgcttggcgcatggcacccgcctggcaagtgctagaactaatgctattcttctggaataagatgccaatgatgtggtggctagaaatgcaacttgtataaaacaaaaatgggagagagagaggtattaaacaaataccccccttagaggatactttctgggtttggaaggtgtgcttgctgtggtactgggtgagcggctcatgtgtgctggctgcatggtgctggggaggccacagccagcccttcctctgcacctgcctcctctgggatgtgcatgtgtgtgtacgtgcttgtggtcatgacgcgtgccatttagagctctcagagcagggcagattgctgggctctggtggccagtgtctgtctgtgagggcaggaaggagagctgcacattgagaacaaaggagggacctgaggtggagagaggcccagcaccccaaatctctgccatcacacggtcggggagcccatacattctgcaacaaccagggacttcacaggagccttgttttcaatttgctaacaggtgcataatccctgtgctccttaagcctcatggccttcctacatttccactttatttgtttgtttgtttatttatttttgagacagtctcgccctgtcacccaggctggagtgcagtggcacgatctcagctcactgcaacctacgccttctgggttcacgtgattctcttgccttagcctcccaagtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttacagtgtataaatgattcctctatttgggagagatcttccaatccagaggagcccctcttggactgcctgggttaaatctgcatagcagaagtggttgatgagttcatctgaagaaattcaggccccacctccccaccctgcccctccctgctcccttttgatggtggcctctgggtactcgggcagagtccttgggacaccagcctctctggggttctcaggccatcccgttggggctgtcgcccaggcctaagtgagtcgtgtgcctctattggaggatggctgttcccctggtggttgcatccaagtatctgtctttctttatggaccacgaagggaagcccaccttcctggaggcaggaccttcggcctaagaaacacaggccctggtgctatctgacctggggtccagcgaggtgggaatcccagtgtgtgagcgacaggccttcttctattgacttacaatattctagaaggacctacgtgtggggacacagttttccaaactgaggaaaatgttgcaataaaagaatatgttgtaagaaag

SEQ ID NO: 108323 - DNA, 2309 bp, Homo sapiens
  Payload ID: 1286
  Gene Symbol: AIFM3
  Gene Name: apoptosis-inducing factor, mitochondrion-associated, 3
  Uniprot ID: Q96NN9
  ENST ID: ENST00000399163
  CDS Start-End: 186-1982
cgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcaga

SEQ ID NO: 108324 - DNA, 2387 bp, Homo sapiens
  Payload ID: 1286
  Gene Symbol: AIFM3
  Gene Name: apoptosis-inducing factor, mitochondrion-associated, 3
  Uniprot ID: Q96NN9
  ENST ID: ENST00000399167
  CDS Start-End: 241-2058
agtgcaaacgcagcgccagacacgccccgcccgcgcctccccgcccccccgcgcccgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 108325 - DNA, 2333 bp, Homo sapiens
  Payload ID: 1286
  Gene Symbol: AIFM3
  Gene Name: apoptosis-inducing factor, mitochondrion-associated, 3
  Uniprot ID: Q96NN9
  ENST ID: ENST00000405089
  CDS Start-End: 190-2004
agtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccaggcgctgccttgcccacagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 108326 - DNA, 2368 bp, Homo sapiens
  Payload ID: 1286
  Gene Symbol: AIFM3
  Gene Name: apoptosis-inducing factor, mitochondrion-associated, 3
  Uniprot ID: Q96NN9
  ENST ID: ENST00000440238
  CDS Start-End: 222-2039
gctcccactgtctctctccgtccctctgtgtctctacctgcccacacgccccggtcctgatggctccagtctcccctgcaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagctgtttgtgctgcacagcaagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgttaaacattaccgtaaaattaaaacgcacaaatttgcagatc

SEQ ID NO: 108327 - DNA, 1092 bp, Homo sapiens
  Payload ID: 1286
  Gene Symbol: AIFM3
  Gene Name: apoptosis-inducing factor, mitochondrion-associated, 3
  ENST ID: ENST00000434714
  CDS Start-End: 286-1092
ctcctggccacagcttgagctgggaggagggtggaggctgggccgcctcctggacccctgccctccctgcccggccttccaaggcccggcagcctcagtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcag

SEQ ID NO: 108328 - DNA, 606 bp, Homo sapiens
  Payload ID: 1286
  Gene Symbol: AIFM3
  Gene Name: apoptosis-inducing factor, mitochondrion-associated, 3
  ENST ID: ENST00000441376
  CDS Start-End: 218-606
aagcggttcccgagcccaggcccgcgccgagcccaggcacccacccacggcccttcctggtatctggaccagaccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctg

SEQ ID NO: 108329 - DNA, 521 bp, Homo sapiens
  Payload ID: 1286
  Gene Symbol: AIFM3
  Gene Name: apoptosis-inducing factor, mitochondrion-associated, 3
  ENST ID: ENST00000426113
  CDS Start-End: 197-421
cagcctcagtccactgctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctg

SEQ ID NO: 108330 - DNA, 789 bp, Homo sapiens
  Payload ID: 1286
  Gene Symbol: AIFM3
  Gene Name: apoptosis-inducing factor, mitochondrion-associated, 3
  ENST ID: ENST00000417515
  CDS Start-End: 182-547
gccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagca

SEQ ID NO: 108331 - DNA, 896 bp, Homo sapiens
  Payload ID: 1287
  Gene Symbol: APITD1
  Gene Name: apoptosis-inducing, TAF9-like domain 1
  Uniprot ID: Q8N2Z9
  ENST ID: ENST00000309048
  CDS Start-End: 76-492
gggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcaaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttag

SEQ ID NO: 108332 - DNA, 914 bp, Homo sapiens
  Payload ID: 1287
  Gene Symbol: APITD1
  Gene Name: apoptosis-inducing, TAF9-like domain 1
  ENST ID: ENST00000477755
  CDS Start-End: 508-744
gaagcggttctaggggagcgtgcgggcgccggggtccggcggcgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaa

SEQ ID NO: 108333 - DNA, 584 bp, Homo sapiens
  Payload ID: 1287
  Gene Symbol: APITD1
  Gene Name: apoptosis-inducing, TAF9-like domain 1
  ENST ID: ENST00000462462
  CDS Start-End: 168-317
cgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatt

SEQ ID NO: 108334 - DNA, 4935 bp, Homo sapiens
  Payload ID: 1288
  Gene Symbol: ACIN1
  Gene Name: apoptotic chromatin condensation inducer 1
  Uniprot ID: Q9UKV3
  ENST ID: ENST00000262710
  CDS Start-End: 329-4354
cttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108335 - DNA, 2445 bp, Homo sapiens
  Payload ID: 1288
  Gene Symbol: ACIN1
  Gene Name: apoptotic chromatin condensation inducer 1
  Uniprot ID: Q9UKV3
  ENST ID: ENST00000338631
  CDS Start-End: 20-1864
ggcaagatggctcccctgcatgtctccggctgatcgctgccgctccgccaatacaatagagccagccactaccagcagcctggccctcttcctccttctccagagagaccaatccagccgaactcggggtttgcctgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108336 - DNA, 2563 bp, Homo sapiens
  Payload ID: 1288
  Gene Symbol: ACIN1
  Gene Name: apoptotic chromatin condensation inducer 1
  Uniprot ID: Q9UKV3
  ENST ID: ENST00000357481
  CDS Start-End: 231-1982
ctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108337 - DNA, 2738 bp, Homo sapiens
  Payload ID: 1288
  Gene Symbol: ACIN1
  Gene Name: apoptotic chromatin condensation inducer 1
  Uniprot ID: Q9UKV3
  ENST ID: ENST00000397341
  CDS Start-End: 419-2170
aagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggttttttttctttattttttttaggattttttttgtttggtttttgttatttcttccattccagaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaat

SEQ ID NO: 108338 - DNA, 4815 bp, Homo sapiens
  Payload ID: 1288
  Gene Symbol: ACIN1
  Gene Name: apoptotic chromatin condensation inducer 1
  ENST ID: ENST00000457657
  CDS Start-End: 329-4234
cttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaaggaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108339 - DNA, 2751 bp, Homo sapiens
  Payload ID: 1288
  Gene Symbol: ACIN1
  Gene Name: apoptotic chromatin condensation inducer 1
  ENST ID: ENST00000557515
  CDS Start-End: 419-2167
aagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggttttttttctttattttttttaggattttttttgtttggtttttgttatttcttccattccagaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 108340 - DNA, 4173 bp, Homo sapiens
  Payload ID: 1288
  Gene Symbol: ACIN1
  Gene Name: apoptotic chromatin condensation inducer 1
  Uniprot ID: Q9UKV3
  ENST ID: ENST00000555053
  CDS Start-End: 98-4084
tcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctgg

SEQ ID NO: 108341 - DNA, 734 bp, Homo sapiens
  Payload ID: 1288
  Gene Symbol: ACIN1
  Gene Name: apoptotic chromatin condensation inducer 1
  ENST ID: ENST00000555566
  CDS Start-End: 152-734
ctccggctgatcgctgccgctccgccaatacaatagagccagccactaccagcagcctggccctcttcctccttctccagagagaccaatccagccgaactcggggtttgccaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcag

SEQ ID NO: 108342 - DNA, 4474 bp, Homo sapiens
  Payload ID: 1288
  Gene Symbol: ACIN1
  Gene Name: apoptotic chromatin condensation inducer 1
  ENST ID: ENST00000605057
  CDS Start-End: 42-3893
tgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108343 - DNA, 579 bp, Homo sapiens
  Payload ID: 1288
  Gene Symbol: ACIN1
  Gene Name: apoptotic chromatin condensation inducer 1
  ENST ID: ENST00000555352
  CDS Start-End: 1-249
cagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgtctttttttctggacattcccatgcaagtccagggcacatgaagcttggagtcatagagtttcctgtccccccactccagtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccct

SEQ ID NO: 108344 - DNA, 3540 bp, Homo sapiens
  Payload ID: 1288
  Gene Symbol: ACIN1
  Gene Name: apoptotic chromatin condensation inducer 1
  ENST ID: ENST00000473758
  CDS Start-End: 1-110
gcaatgatgaccgcccggagggcagtgttgaagatgaggagaagaaagagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtacacagtgaggtgcgattggctgaactgaagatcccagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 108345 - DNA, 4539 bp, Homo sapiens
  Payload ID: 1289
  Gene Symbol: APAF1
  Gene Name: apoptotic peptidase activating factor 1
  Uniprot ID: O14727
  ENST ID: ENST00000333991
  CDS Start-End: 578-1594
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 108346 - DNA, 7055 bp, Homo sapiens
  Payload ID: 1289
  Gene Symbol: APAF1
  Gene Name: apoptotic peptidase activating factor 1
  Uniprot ID: O14727
  ENST ID: ENST00000357310
  CDS Start-End: 578-4195
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 108347 - DNA, 7029 bp, Homo sapiens
  Payload ID: 1289
  Gene Symbol: APAF1
  Gene Name: apoptotic peptidase activating factor 1
  Uniprot ID: O14727
  ENST ID: ENST00000359972
  CDS Start-End: 578-4162
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaaca

SEQ ID NO: 108348 - DNA, 3492 bp, Homo sapiens
  Payload ID: 1289
  Gene Symbol: APAF1
  Gene Name: apoptotic peptidase activating factor 1
  ENST ID: ENST00000549007
  CDS Start-End: 1-3492
atggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataa

SEQ ID NO: 108349 - DNA, 5444 bp, Homo sapiens
  Payload ID: 1289
  Gene Symbol: APAF1
  Gene Name: apoptotic peptidase activating factor 1
  Uniprot ID: O14727
  ENST ID: ENST00000551964
  CDS Start-End: 737-4483
acttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgg

SEQ ID NO: 108350 - DNA, 6581 bp, Homo sapiens
  Payload ID: 1289
  Gene Symbol: APAF1
  Gene Name: apoptotic peptidase activating factor 1
  Uniprot ID: O14727
  ENST ID: ENST00000550527
  CDS Start-End: 8-3721
agggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttg

SEQ ID NO: 108351 - DNA, 1143 bp, Homo sapiens
  Payload ID: 1289
  Gene Symbol: APAF1
  Gene Name: apoptotic peptidase activating factor 1
  Uniprot ID: O14727
  ENST ID: ENST00000552268
  CDS Start-End: 45-1061
tagctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaa

SEQ ID NO: 108352 - DNA, 3744 bp, Homo sapiens
  Payload ID: 1289
  Gene Symbol: APAF1
  Gene Name: apoptotic peptidase activating factor 1
  Uniprot ID: O14727
  ENST ID: ENST00000547045
  CDS Start-End: 6-3623
ggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcatta

SEQ ID NO: 108353 - DNA, 651 bp, Homo sapiens
  Payload ID: 1289
  Gene Symbol: APAF1
  Gene Name: apoptotic peptidase activating factor 1
  ENST ID: ENST00000547743
  CDS Start-End: 207-599
gcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatggtttgtatccattataccttctatcactttgctatcaaaattgctttgggtttgtcttattgtagatgtaatcttttgaagagagtgtgaccagttcactgaaaactgcatgttaaa

SEQ ID NO: 108354 - DNA, 1859 bp, Homo sapiens
  Payload ID: 1290
  Gene Symbol: APTX
  Gene Name: aprataxin
  Uniprot ID: Q7Z2E3
  ENST ID: ENST00000309615
  CDS Start-End: 102-968
aggcacagatgagtaacgtgaatttgtccgtctccgacttctggaggtaaggcggtcgtcagcctatctcttctgctggctgggctcaatgccgcggagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagttgtattc

SEQ ID NO: 108355 - DNA, 599 bp, Homo sapiens
  Payload ID: 1290
  Gene Symbol: APTX
  Gene Name: aprataxin
  ENST ID: ENST00000379812
  CDS Start-End: 4-599
cagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgag

SEQ ID NO: 108356 - DNA, 1121 bp, Homo sapiens
  Payload ID: 1290
  Gene Symbol: APTX
  Gene Name: aprataxin
  ENST ID: ENST00000379813
  CDS Start-End: 9-1019
aggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaa

SEQ ID NO: 108357 - DNA, 2106 bp, Homo sapiens
  Payload ID: 1290
  Gene Symbol: APTX
  Gene Name: aprataxin
  Uniprot ID: Q7Z2E3
  ENST ID: ENST00000379817
  CDS Start-End: 198-1226
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108358 - DNA, 1820 bp, Homo sapiens
  Payload ID: 1290
  Gene Symbol: APTX
  Gene Name: aprataxin
  Uniprot ID: Q7Z2E3
  ENST ID: ENST00000379819
  CDS Start-End: 1-1071
atgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaa

SEQ ID NO: 108359 - DNA, 2023 bp, Homo sapiens
  Payload ID: 1290
  Gene Symbol: APTX
  Gene Name: aprataxin
  Uniprot ID: Q7Z2E3
  ENST ID: ENST00000379825
  CDS Start-End: 25-945
agcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagttgtattca

SEQ ID NO: 108360 - DNA, 1740 bp, Homo sapiens
  Payload ID: 1290
  Gene Symbol: APTX
  Gene Name: aprataxin
  Uniprot ID: Q7Z2E3
  ENST ID: ENST00000397172
  CDS Start-End: 4-858
cagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaaca

SEQ ID NO: 108361 - DNA, 2168 bp, Homo sapiens
  Payload ID: 1290
  Gene Symbol: APTX
  Gene Name: aprataxin
  Uniprot ID: Q7Z2E3
  ENST ID: ENST00000436040
  CDS Start-End: 249-1277
acttctggaggtaaggcggtcgtcagcctatctcttctgctggctgggctcaatgccgcgggtgagcgttcggccgaggctgctcctacccttgagtgatgtgccttgaatgacgctgctttcatgcgctgctctcacggctgctttctccgtcctcccctgttactaccttgggctgtttcagcgggcgctcgcgttggtcttcgacccactttgcgtttgttcacgtgtgctcccgacacctagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagttgtattc

SEQ ID NO: 108362 - DNA, 2099 bp, Homo sapiens
  Payload ID: 1290
  Gene Symbol: APTX
  Gene Name: aprataxin
  Uniprot ID: Q7Z2E3
  ENST ID: ENST00000494649
  CDS Start-End: 194-343
ccgcgggtgagcgttcggccgaggctgctcctacccttgagtgatgtgccttgaatgacgctgctttcatgcgctgctctcacggctgctttctccgtcctcccctgttactaccttgggctgtttcagcgggcgctcgcgttggtcttcgacccactttgcgtttgttcacgtgtgctcccgacacctagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaaca

SEQ ID NO: 108363 - DNA, 568 bp, Homo sapiens
  Payload ID: 1290
  Gene Symbol: APTX
  Gene Name: aprataxin
  ENST ID: ENST00000477119
  CDS Start-End: 102-568
aggcacagatgagtaacgtgaatttgtccgtctccgacttctggaggtaaggcggtcgtcagcctatctcttctgctggctgggctcaatgccgcggagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccat

SEQ ID NO: 108364 - DNA, 674 bp, Homo sapiens
  Payload ID: 1290
  Gene Symbol: APTX
  Gene Name: aprataxin
  ENST ID: ENST00000480031
  CDS Start-End: 36-194
acgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacac

SEQ ID NO: 108365 - DNA, 952 bp, Homo sapiens
  Payload ID: 1290
  Gene Symbol: APTX
  Gene Name: aprataxin
  ENST ID: ENST00000474658
  CDS Start-End: 1-224
ccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacc

SEQ ID NO: 108366 - DNA, 1759 bp, Homo sapiens
  Payload ID: 1290
  Gene Symbol: APTX
  Gene Name: aprataxin
  Uniprot ID: Q7Z2E3
  ENST ID: ENST00000472896
  CDS Start-End: 198-347
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108367 - DNA, 679 bp, Homo sapiens
  Payload ID: 1290
  Gene Symbol: APTX
  Gene Name: aprataxin
  ENST ID: ENST00000464632
  CDS Start-End: 16-207
agcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgat

SEQ ID NO: 108368 - DNA, 1986 bp, Homo sapiens
  Payload ID: 1290
  Gene Symbol: APTX
  Gene Name: aprataxin
  Uniprot ID: Q7Z2E3
  ENST ID: ENST00000485479
  CDS Start-End: 198-347
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108369 - DNA, 1874 bp, Homo sapiens
  Payload ID: 1290
  Gene Symbol: APTX
  Gene Name: aprataxin
  Uniprot ID: Q7Z2E3
  ENST ID: ENST00000460940
  CDS Start-End: 198-347
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108370 - DNA, 2101 bp, Homo sapiens
  Payload ID: 1290
  Gene Symbol: APTX
  Gene Name: aprataxin
  Uniprot ID: Q7Z2E3
  ENST ID: ENST00000467331
  CDS Start-End: 198-347
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108371 - DNA, 687 bp, Homo sapiens
  Payload ID: 1290
  Gene Symbol: APTX
  Gene Name: aprataxin
  ENST ID: ENST00000473221
  CDS Start-End: 38-687
gacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgag

SEQ ID NO: 108372 - DNA, 1068 bp, Homo sapiens
  Payload ID: 1290
  Gene Symbol: APTX
  Gene Name: aprataxin
  Uniprot ID: Q7Z2E3
  ENST ID: ENST00000476858
  CDS Start-End: 38-946
gacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaa

SEQ ID NO: 108373 - DNA, 1879 bp, Homo sapiens
  Payload ID: 1290
  Gene Symbol: APTX
  Gene Name: aprataxin
  Uniprot ID: Q7Z2E3
  ENST ID: ENST00000482687
  CDS Start-End: 198-776
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108374 - DNA, 1991 bp, Homo sapiens
  Payload ID: 1290
  Gene Symbol: APTX
  Gene Name: aprataxin
  ENST ID: ENST00000465003
  CDS Start-End: 198-455
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108375 - DNA, 684 bp, Homo sapiens
  Payload ID: 1290
  Gene Symbol: APTX
  Gene Name: aprataxin
  ENST ID: ENST00000478279
  CDS Start-End: 16-315
agcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgat

SEQ ID NO: 108376 - DNA, 1313 bp, Homo sapiens
  Payload ID: 1290
  Gene Symbol: APTX
  Gene Name: aprataxin
  Uniprot ID: Q7Z2E3
  ENST ID: ENST00000495360
  CDS Start-End: 314-463
tggtgctagcgcggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcattt

SEQ ID NO: 108377 - DNA, 1764 bp, Homo sapiens
  Payload ID: 1290
  Gene Symbol: APTX
  Gene Name: aprataxin
  ENST ID: ENST00000483148
  CDS Start-End: 198-455
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaa

SEQ ID NO: 108378 - DNA, 1345 bp, Homo sapiens
  Payload ID: 1290
  Gene Symbol: APTX
  Gene Name: aprataxin
  Uniprot ID: Q7Z2E3
  ENST ID: ENST00000463596
  CDS Start-End: 195-1223
gccgcgggtgagcgttcggccgaggctgctcctacccttgagtgatgtgccttgaatgacgctgctttcatgcgctgctctcacggctgctttctccgtcctcccctgttactaccttgggctgtttcagcgggcgctcgcgttggtcttcgacccactttgcgtttgttcacgtgtgctcccgacacctagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaa

SEQ ID NO: 108379 - DNA, 1881 bp, Homo sapiens
  Payload ID: 1290
  Gene Symbol: APTX
  Gene Name: aprataxin
  Uniprot ID: Q7Z2E3
  ENST ID: ENST00000479656
  CDS Start-End: 123-272
ctcctccacaagatttattttttttagatgaggtgttgctgtgttgcccaagctggacttgaacccctaggctcaagcaatccttccacctcagtctcccaagtagcagggactacagagtgatgatgcgggtgtgctggttggtgagacaggacagccggcaccagcgaatcagacttccacatttggaagcagttgtgattgggcgtggcccagagaccaagatcactgataagaaatgttctcgacagcaagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttga

SEQ ID NO: 108380 - DNA, 1455 bp, Homo sapiens
  Payload ID: 1290
  Gene Symbol: APTX
  Gene Name: aprataxin
  Uniprot ID: Q7Z2E3
  ENST ID: ENST00000468275
  CDS Start-End: 94-1122
gaggtgttgctgtgttgcccaagctggacttgaacccctaggctcaagcaatccttccacctcagtctcccaagtagcagggactacagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggtt

SEQ ID NO: 108381 - DNA, 3847 bp, Homo sapiens
  Payload ID: 1291
  Gene Symbol: APLF
  Gene Name: aprataxin and PNKP like factor
  Uniprot ID: Q8IW19
  ENST ID: ENST00000303795
  CDS Start-End: 172-1707
gaagctgcgctggggccgggctctgagaggaccggcgcagccgcggggagcctttgaggccctccctcggtgttttttcccagggcgtgggcttgccccgcgcgtgtctgtggagggcggaaacagcggaggggccagtctcctggcgaaggggcctaatccttgcccgccatgtccgggggcttcgagctgcagccgcgggacggcggtccccgggtggccctggcgcccggggagacggtgatcggccgcgggccgctgctgggaataacagacaagagagtatccagaagacatgccattcttgaggtggcaggtggtcagctgcgaatcaaaccgatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaagaaacagtcaagtgcttgatgaagataatatattgaatgaaacaccaaaatcccccgtgattaatttacctcatgagactactggtgcctcacaactggaaggaagcacagaaatagccaagacccagatgactcccacaaatagtgtgtctttcctaggtgaaaatagagactgcaataagcagcagccaatccttgccgagaggaaaagaatccttccaacttggatgttagcagaacatttaagtgatcaaaacctttcagtaccagcaatcagtggaggtaatgtaatccagggaagtggaaaagaagaaatctgcaaagataaatcccagctaaacacaacccagcaaggaagaaggcaattaatttcatcaggaagttcagaaaatacatcagcagaacaagacacaggagaagagtgcaaaaatactgatcaggaagagtctaccatttcatccaaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgaccttttttttcaaactaaagtcctagctgattattttaactctcagtgtgctgtctttatattaagaatagagaaacgacataactttctcaaatggcattagttttgccttagtttttttgacctcagatgaaagtagcaagttgtttgccagttgaaagttcaagattctggcctcccatatcaagaagaaaccacttattctccagttttacaaagtatctttctgtatttctgttctaaaactactttaagccctataatgctcttcatattacgtgactttgaattgttaaaatgtagtttagaatctttaataacagttgggttgtgtacacagagcaggagatatttattgaaatcataaatcactaagccaaaagaatctttgttaaatgctattattttctactctaaaggaacctaaaaatttatatcttaaaagatcaaaacatatttataataatattttctcattgctttaaaatatatctcccagtaattatacaatatttaatatttacttaaactggaacaagaataagataaacatttctctagactataacctattattctgatttttatctcttattgttatttgggaactatttttccccttataatgtccctttagccttggtagtataacaaatctacgaatgtaatatttaacttattctcatccctgccactaacttaatccttgaagtgttacataatctactcctaggtatatacccagaggaattgaaaacatttccacataaaaactgtacacaatgtcaatagaagcattattcttaacagccaaaaagtataaacacccaaagtctatcaactatcaactgggtgaatggataagcaaaacgtggtatatctgtgcaatggaatattatttggtcataaaaaggaataaagtactgatacatgctacaagatagatgaaccttgaaggcaagtaaaagaagccagacacaaaaggccacatactgtatgaactcatttatatgaaatttccaaaacaggcaaatccataaagacagaaagcaaatttgtggttgccagggacttggggaggaagaatggggagtgactgctaatgagtataggatttccttttgagtgataaaaatgttctaagattagatggcagtgatggttgcacaactctgtaaatatattacaaacaatgcattgtacactttcaaagggtagatttcattgcacgtgaactatatatttcaataaatctgtcacaaaaaagtaatgcaaagggtaataccagtcttttagaaggaaaaaaatatttaatatcaaaggatattcttcgtagtaatgtaatagttcatggtagctgcttttaacgatacagttttaatgcaactttcataatcatcctgaagacacttttgagtataactattgtataaataaatgtatagcttaattga

SEQ ID NO: 108382 - DNA, 1182 bp, Homo sapiens
  Payload ID: 1291
  Gene Symbol: APLF
  Gene Name: aprataxin and PNKP like factor
  ENST ID: ENST00000394342
  CDS Start-End: 1-1182
atggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgtttgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaataa

SEQ ID NO: 108383 - DNA, 3906 bp, Homo sapiens
  Payload ID: 1291
  Gene Symbol: APLF
  Gene Name: aprataxin and PNKP like factor
  ENST ID: ENST00000445692
  CDS Start-End: 130-972
gcggggagcctttgaggccctccctcggtgttttttcccagggcgtgggcttgccccgcgcgtgtctgtggagggcggaaacagcggaggggccagtctcctggcgaaggggcctaatccttgcccgccatgtccgggggcttcgagctgcagccgcgggacggcggtccccgggtggccctggcgcccggggagacggtgatcggccgcgggccgctgctgggaataacagacaagagagtatccagaagacatgccattcttgaggtggcaggtggtcagctgcgaatcaaaccgatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaagaaacagtcaagtgcttgatgaagataatatattgaatgaaacaccaaaatcccccgtgattaatttacctcatgagactactggtgcctcacaactggaaggaagcacagaaatagccaagacccagatgactcccacaaatagtgtgtctttcctaggtgaaaatagagactgcaataagcagcagccaatccttgccgagaggaaaagaatccttccaacttggatgttagcagaacatttaagtgatcaaaacctttcagtaccagcaatcagtggaggtaatgtaatccagggaagtggaaaagaagaaatctgcaaagataaatcccagctaaacacaacccagcaaggaagaaggcaattaatttcatcaggaagttcagaaaatacatcagcagaacaagacacaggagaagagtgcaaaaatactgatcaggaagagtctaccatttcatccaagatgcttattgtcaaaaatggaagtatcagaagcatttgaagtaaataatgaaaacctccatttgcctcatccttcgacctcattgcgttactaattttttggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgaccttttttttcaaactaaagtcctagctgattattttaactctcagtgtgctgtctttatattaagaatagagaaacgacataactttctcaaatggcattagttttgccttagtttttttgacctcagatgaaagtagcaagttgtttgccagttgaaagttcaagattctggcctcccatatcaagaagaaaccacttattctccagttttacaaagtatctttctgtatttctgttctaaaactactttaagccctataatgctcttcatattacgtgactttgaattgttaaaatgtagtttagaatctttaataacagttgggttgtgtacacagagcaggagatatttattgaaatcataaatcactaagccaaaagaatctttgttaaatgctattattttctactctaaaggaacctaaaaatttatatcttaaaagatcaaaacatatttataataatattttctcattgctttaaaatatatctcccagtaattatacaatatttaatatttacttaaactggaacaagaataagataaacatttctctagactataacctattattctgatttttatctcttattgttatttgggaactatttttccccttataatgtccctttagccttggtagtataacaaatctacgaatgtaatatttaacttattctcatccctgccactaacttaatccttgaagtgttacataatctactcctaggtatatacccagaggaattgaaaacatttccacataaaaactgtacacaatgtcaatagaagcattattcttaacagccaaaaagtataaacacccaaagtctatcaactatcaactgggtgaatggataagcaaaacgtggtatatctgtgcaatggaatattatttggtcataaaaaggaataaagtactgatacatgctacaagatagatgaaccttgaaggcaagtaaaagaagccagacacaaaaggccacatactgtatgaactcatttatatgaaatttccaaaacaggcaaatccataaagacagaaagcaaatttgtggttgccagggacttggggaggaagaatggggagtgactgctaatgagtataggatttccttttgagtgataaaaatgttctaagattagatggcagtgatggttgcacaactctgtaaatatattacaaacaatgcattgtacactttcaaagggtagatttcattgcacgtgaactatatatttcaataaatctgtcacaaaaaagtaatgcaaagggtaataccagtcttttagaaggaaaaaaatatttaatatcaaaggatattcttcgtagtaatgtaatagttcatggtagctgcttttaacgatacagttttaatgcaactttcataatcatcctgaagacacttttgagtataactattgtataaataaatgtatagcttaattga

SEQ ID NO: 108384 - DNA, 2863 bp, Homo sapiens
  Payload ID: 1291
  Gene Symbol: APLF
  Gene Name: aprataxin and PNKP like factor
  ENST ID: ENST00000529851
  CDS Start-End: 161-718
ggggccgggctctgagaggaccggcgcagccgcggggagcctttgaggccctccctcggtgttttttcccagggcgtgggcttgccccgcgcgtgtctgtggagggcggaaacagcggaggggccagtctcctggcgaaggggcctaatccttgcccgccatgtccgggggcttcgagctgcagccgcgggacggcggtccccgggtggccctggcgcccggggagacggtgatcggccgcgggccgctgctgggaatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaagaaacagtcaagtgcttgatgaagataatatattgaatgaaacaccaaaatcccccgtgattaatttacctcatgagactactggtgcctcacaactggaaggaagcacagaaatagccaagacccagatgactcccacaaatagtgtgtctttcctaggtgaaaatagagactgcaataagcagcagccaatccttgccgagaggaaaagaatccttccaacttggatgttagcagaacatttaagtgatcaaaacctttcagtaccagcaatcagtggaggtaggtaatgtaatccagggaagtggaaaagaagaaatctgcaaagataaatcccagctaaacacaacccagcaaggaagaaggcaattaatttcatcaggaagttcagaaaatacatcagcagaacaagacacaggagaagagtgcaaaaatactgatcaggaagagtctaccatttcatccaaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgaccttttttttcaaactaaagtcctagctgattattttaactctcagtgtgctgtctttatattaagaatagagaaacgacataactttctcaaatggcattagttttgccttagtttttttgacctcagatgaaagtagcaagttgtttgccagttgaaagttcaagattctggcctcccatatcaagaagaaaccacttattctccagttttacaaagtatctttctgtatttctgttctaaaactactttaagccctataatgctcttcatattacgtgactttgaattgttaaaatgtagtttagaatctttaataacagttgggttgtgtacacagagcaggagatatttattgaaatcataaatcactaagccaaaagaatctttgttaaatgctattattttctactctaaaggaacctaaaaatttatatcttaaaagatcaaaacatatttataataatattttctcattgctttaaaatatatctcccagtaattatacaatatttaatatttacttaaactggaacaagaataagataa

SEQ ID NO: 108385 - DNA, 2752 bp, Homo sapiens
  Payload ID: 1292
  Gene Symbol: AQP1
  Gene Name: aquaporin 1 (Colton blood group)
  Uniprot ID: P29972
  ENST ID: ENST00000311813
  CDS Start-End: 56-865
ctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 108386 - DNA, 1009 bp, Homo sapiens
  Payload ID: 1292
  Gene Symbol: AQP1
  Gene Name: aquaporin 1 (Colton blood group)
  Uniprot ID: P29972
  ENST ID: ENST00000409899
  CDS Start-End: 153-617
aagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttggctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcc

SEQ ID NO: 108387 - DNA, 1140 bp, Homo sapiens
  Payload ID: 1292
  Gene Symbol: AQP1
  Gene Name: aquaporin 1 (Colton blood group)
  Uniprot ID: P29972
  ENST ID: ENST00000409611
  CDS Start-End: 119-775
gagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcct

SEQ ID NO: 108388 - DNA, 2487 bp, Homo sapiens
  Payload ID: 1292
  Gene Symbol: AQP1
  Gene Name: aquaporin 1 (Colton blood group)
  Uniprot ID: P29972
  ENST ID: ENST00000441328
  CDS Start-End: 40-600
taaaagtggcccaggagagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 108389 - DNA, 1791 bp, Homo sapiens
  Payload ID: 1293
  Gene Symbol: AQP10
  Gene Name: aquaporin 10
  Uniprot ID: Q96PS8
  ENST ID: ENST00000324978
  CDS Start-End: 41-946
agacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatgctcctcacccaaggagctgtggcccaggctgtcaccagtggagaaaccaaaggcaacttcttcaccatgtttctggctggctctctggccgttacgatagccatctacgtgggtggtaacgtctcaggggcccacctgaatccagccttctccctggccatgtgcatcgttggacgcctcccctgggtcaagctccccatttacatcttggtgcagttgctgtctgctttctgtgcttcgggagccacctatgttctctaccatgatgccctacagaactatacaggtgggaacctgacagtgactggccccaaggagacagcctccatttttgccacctatcctgccccctatctgtccctgaacaatggcttcctggatcaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcga

SEQ ID NO: 108390 - DNA, 2262 bp, Homo sapiens
  Payload ID: 1293
  Gene Symbol: AQP10
  Gene Name: aquaporin 10
  Uniprot ID: Q96PS8
  ENST ID: ENST00000484864
  CDS Start-End: 37-831
agagggagcagtgaatagcaatagggtgtttccaccatggtcttcactcaggccccggctgaaatcatgggccacctccggatacgcagcctcctggcccggcagtgcctggcagagtttctgggtgtgtttgtactcatgctcctcacccaaggagctgtggcccaggctgtcaccagtggagaaaccaaaggcaacttcttcaccatgtttctggctggctctctggccgttacgatagccatctacgtgggtggtaacgtctcaggggcccacctgaatccagccttctccctggccatgtgcatcgttggacgcctcccctgggtcaagctccccatttacatcttggtgcagttgctgtctgctttctgtgcttcgggagccacctatgttctctaccatgatgccctacagaactatacaggtgggaacctgacagtgactggccccaaggagacagcctccatttttgccacctatcctgccccctatctgtccctgaacaatggcttcctggatcaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcaggtgggagacagactctcctggtgctggcctccactcaccttcctctgctaagggctctgtccctgggtccacagcactctgcctttaaaatagctctcttggcttcttaggacagtgttctttctccaagtcatattctccccctttctcccttgcttccctcccaacttttcactgaaacagtaagatttagaggttgtgttcttaggcatgccacattacttccatgcacattagtgacttcatcagcaaaattaatatattcagataattccctaaggcaagaggctggaccaagctctcctggggttccctcttctaaatactatgctttggtgacaaggcaatcctcttcctggtgtctaccaccctgggaacaactttagggcactctcttgttactgccccccgtccttggagaggggaaggctaagggagtcactcctgataccttcccactgtccttcttttgcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcga

SEQ ID NO: 108391 - DNA, 2152 bp, Homo sapiens
  Payload ID: 1294
  Gene Symbol: AQP11
  Gene Name: aquaporin 11
  Uniprot ID: Q8NBQ7
  ENST ID: ENST00000313578
  CDS Start-End: 359-1174
tccgccgccgcgcccgcctacaaggccctgagggagactgcggagggtgagtgcgcggtgggctcggctgaccgttggccctgcggccggcgccctaggctacctcccttcgcctccccgcgcctccccgcgcctccccgcctccccgcctccccgcctcctcggctctggttccaacaccccagcgccaagccggggaggcggggaggacttcttaagtgtgccgctcgggagcctcccgctcgtcccgccccgaggggcgtgaggaggggaggggctgcggacttcggactcgggcctggagaccgcctcctacccagagccggagcccgcaacccgctcaggcggcgacggagccatgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcagatgatgctggggggcatgtcccccgagacgggtgcggtgaggctattggctcagctggttagtgccctgtgcagcaggtactgcacaagcgccttgtggagcttgggtctgacccagtatcacgtcagcgagaggagcttcgcttgcaagaatcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggaggaagtctaacaggagctgtatttaatccagctttggcactttcgctacatttcatgtgttttgatgaagcattccctcagttttttatagtatactggctggctccttctttaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatcttaaatgataattgttaactttgatgaaaaacgagtacaggatgagaagggaagtaaaggtgatagtaagatcaacgaatttgtgtatcaagtgtcacccaaatgaacagaatttttaactataaaagtacaaggcgtcaacttacagaactggggagaggatactttcagccaccacctcacaaaatgataccatcaagcagtgtcatctttcaacaggaaagttgcttttagaagtagaatatatattcactcacatgcaagcgatttcctacattttaagtacattaaaatctaatacctaaaatagtttctctaaatagacaatctcactagctccagccaagtggttattctttaatagaatataataaaacaaaacacccatacaaagtcaggatttaagcttttcacattctcctttgaaccaacagctagctaccttatgaagtagggagggcatgtatttttaatctccattttacagataaggaaactaagcctagatgggtttgctgccctggcttagatcacatagagccaaataccatctctagtcttcaacttcaatccaaaaattcttctcggtcacgattatgactaaagggaaatcaagggttcatagaaacattaaatactttataataacgttaaaacttgtttagaaattaactagtattttttgaggtttaaagaaccttccagttttac

SEQ ID NO: 108392 - DNA, 1084 bp, Homo sapiens
  Payload ID: 1295
  Gene Symbol: AQP12A
  Gene Name: aquaporin 12A
  Uniprot ID: Q8IXF9
  ENST ID: ENST00000337801
  CDS Start-End: 70-957
gaaccagccagctcctgctctgtcccctcaggtgtcctgcaggcacagctcctcggggggcccaggccgatggcaggtcttaacgtgtccctctccttcttctttgccaccttcgccctctgtgaggcggccaggcgggcctccaaggccctgctcccagtgggcgcctatgaagtcttcgcccgggaggcgatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaga

SEQ ID NO: 108393 - DNA, 1110 bp, Homo sapiens
  Payload ID: 1295
  Gene Symbol: AQP12A
  Gene Name: aquaporin 12A
  ENST ID: ENST00000429564
  CDS Start-End: 64-987
gccagctcctgctctgtcccctcaggtgtcctgcaggcacagctcctcggggggcccaggccgatggcaggtcttaacgtgtccctctccttcttctttgccaccttcgccctctgtgaggcggccaggcgggcctccaaggccctgctcccagtgggcgcctatgaagtcttcgcccgggaggcggtgggtgcggtgcagctcgggccctgctgcctggagatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttct

SEQ ID NO: 108394 - DNA, 1094 bp, Homo sapiens
  Payload ID: 1296
  Gene Symbol: AQP12B
  Gene Name: aquaporin 12B
  Uniprot ID: A6NM10
  ENST ID: ENST00000407834
  CDS Start-End: 64-987
gccagctcctgctctgtcccctcaggtgtcctgcaggcacagcatctcggggggcccaggccgatggcaggtcttaacgtgtccctctccttcttctttgccaccttcaccctctgtgaggcagccaggcgggcctccaaggccctgctcccagtgggcgcctatgaagtcttcgcccgggaggcggtgggcgcggtgcagctcggggcctgcttcctggagatgaggacgctggtcgagctcgggccctgggctggggactttgggcctgacctgctgctcaccctgctcttcctgctcttcctggcgcacggggtcaccttggacggggcctcggccaaccccaccgtgtccctgcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttg

SEQ ID NO: 108395 - DNA, 3013 bp, Homo sapiens
  Payload ID: 1296
  Gene Symbol: AQP12B
  Gene Name: aquaporin 12B
  ENST ID: ENST00000414322
  CDS Start-End: 70-195
gaaccggccagctcctgctctgtcccctcaggtgtcctgcaggcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagaggagcagcatggggaggtcatggagccccctcttggacctagatctggggattctggcccctggcttcagaggcccaggtggagcccacaccttctcctgcacctgctctcagacactcggctccacctcactgaggtaccagaagggcagctgggttcctatggaattctggaagcttttttcagcttctgctggctctacactggggaggtctcaggggcaatgcctcagcctccccttggggggaaagacaggagctgggggtctctcaggcacctggccctgcgatggtgacactgacgtcatcgtgatttgtcgccatggttctgatgtggtcacagtctctcaggcatgtgcagggtcctaggaagcatacgaagtgcatcaggaaccccctcctgcccccgttgccgaggcagcactgccctctgctaggaacagctccgtgttggcctctctgtccccacacactgggcctgcagggcttctccgagactcttcagttcaggtatcaaccctgggctgtctcctgggatgtggggggcggatgttctttccttgcctccccacgctcctcctgcggatccttcactccgggtgggtcggcctcttcctcctgatcagctccagagccccctctagttccctggcatggaaacacggcccgggtgagctgtggtggccccggaggcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctctggaggctggagtctgagctggcagcactgacagggtcagctctcctcggaggctgctggggaggagcctcctgcctcttccgggctccgggggcctctggcacccccggtgtccccgggcttggagacgcagcactcccatgtctgccggttcccctggccgcctcctctgtgtcattgtctgttctcttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccaaagggcatttgcggcttctaggagccaagtaggaggaggctgggatccgtgtttcaggcgggactccaggcttgggcgggcctgatactcgagtccacatgccccctctagagaggaacctgtctcctgccagggccagggaggggggcactggctgcttctgtattttggggtttggggccctggagcttcccatgcggaattgccgtccctcctcctaggcgagtcccagggccaccccatcccacagggacccgggcgccagcttctgaaagcatggggcatctgcggaagaactgggttgtttcccagctttcgtccctgcggaggggcgatccggcccctccatgtcagcagtgtttggtcgtccacatgcttgtcagccccacgctgtgctcctgcgtctcttcccgtctcatccatctggatgcttgacacctctgacagcatccctttcctgtcatcttagggcagcttcaggaaaccgaaaaacaggcttgtgtccttccattaacccctttatccacaagttcagtatcagcatgagccctggggagctccaaggctgcagccaggagccccgtagccagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaga

SEQ ID NO: 108396 - DNA, 644 bp, Homo sapiens
  Payload ID: 1296
  Gene Symbol: AQP12B
  Gene Name: aquaporin 12B
  ENST ID: ENST00000452886
  CDS Start-End: 44-169
ctcaggtgtcctgcaggcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagtctctcaggcatgtgcagggtcctaggaagcatacgaagtgcatcaggaaccccctcctgcccccgttgccgaggcagcactgccctctgctaggaacagctccgtgttggcctctctgtccccacacactgggcctgcagggcttctccgagactcttcagttcag

SEQ ID NO: 108397 - DNA, 751 bp, Homo sapiens
  Payload ID: 1296
  Gene Symbol: AQP12B
  Gene Name: aquaporin 12B
  ENST ID: ENST00000413999
  CDS Start-End: 28-153
gcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccc

SEQ ID NO: 108398 - DNA, 1080 bp, Homo sapiens
  Payload ID: 1296
  Gene Symbol: AQP12B
  Gene Name: aquaporin 12B
  Uniprot ID: A6NM10
  ENST ID: ENST00000621682
  CDS Start-End: 70-957
gaaccggccagctcctgctctgtcccctcaggtgtcctgcaggcacagcatctcggggggcccaggccgatggcaggtcttaacgtgtccctctccttcttctttgccaccttcaccctctgtgaggcagccaggcgggcctccaaggccctgctcccagtgggcgcctatgaagtcttcgcccgggaggcgatgaggacgctggtcgagctcgggccctgggctggggactttgggcctgacctgctgctcaccctgctcttcctgctcttcctggcgcacggggtcaccttggacggggcctcggccaaccccaccgtgtccctgcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagggatggtcctggctgtgctgctgcaccagggccgccttccccaccttttccagaggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttct

SEQ ID NO: 108399 - DNA, 4174 bp, Homo sapiens
  Payload ID: 1297
  Gene Symbol: AQP2
  Gene Name: aquaporin 2 (collecting duct)
  Uniprot ID: P41181
  ENST ID: ENST00000199280
  CDS Start-End: 86-901
gaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttgggatccattacaccggctgctctatgaatcctgcccgctccctggctccagctgtcgtcactggcaaatttgatgaccactgggtcttctggatcggacccctggtgggcgccatcctgggctccctcctctacaactacgtgctgtttccgccagccaagagcctgtcggagcgcctggcagtgctgaagggcctggagccggacaccgattgggaggagcgcgaggtgcgacggcggcagtcggtggagctgcactcgccgcagagcctgccacggggtaccaaggcctgagggccgccagcggcctctacggccccgacggacgcttgtgaggcccgaggcagaagggcccaccccgtccctcctctcccgcaggtctgaagttggccccccagcgcagagtagctgcttcctggacgtgcgcgcccaggccagtgctgtgagcaggcggggaggaggctgccggagggagccctgagcctggcaggtcccctgccctgaggctgtgagcagctagtggtggcttctccagcctttttcagggaactgggaacttaggggactgagctggggagggaggcaggtgggtggtaagagggaaactctggagagcctgcacccaggtactgagtggggagtgtacagacccctgccttgggggttccgggaatgatgcaactggttttactagtgtgcaagtgtgttcatccccaagttctcttttgtcctcacatgcagagttgtgcatgcccctgagtgtgaacaggtttgcctacgttggtgcaagtgtgcatggctggggacttctcacttccccttgcaccccttcctccccaacctgcaataaatccgcttctcctgcagtggatgagtgtgggtgccagtcctcctcaggagaaggggaagggaaggaggccactttgagagggctgaagggagggccttgatttccagccgcaatctggctcctcctggaaaatttcccccacctgcagcgctgggccccaaggcttgccaagactcattgctggaggtagagaggtgtcaaccagagaacagctcccctagacatggcctctggaaaaaggaaatctttggtggccaaagatttcctttctgtggtgagggagaacctctccaaagaggaagcaggcatatgagtgcgcacgccttcacgtgtgtgtatgctgtgtgtgcccgggacccccgtctccaggggtgccccagacccagagattagcctcccacttcggcgcagaaaacaaaagccctttgtgggacccgggcctttgtcttgggtgaggggagatttgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgctctcaggaccagagaagggaaatgacttctccaggcagaggcagatctgagtctagaacccaggcttctaaatttctaggccagtactactgctctcaaaagagattaactgggattaagtgagatgacgcatgtaaagatgctgtgtaaactgtaattcttaataccattatcacgcattactagaatcatttcattatttctgcttcctgggggaaggatgcagaaggagtctgatgctcaacatcccttacctcctttcgttgatggccaaagcaaaggagagtcctgggagcccacaagatccaggcagaaggagatgggtttggggctggccccatcctggcccagcctcttaacctcttcttaccctgaatgtgtgccctatcttttctcccacctccttcctcctaccacccagccctatccattctctccttccctctccagcctgctgtataagtaacatgtgggtcataccttgaacccccctccgcccccatgctctctgtggcctccatgccttcaagacttctgtctgtatctatctcacactgcaccaagcacccactgtgcaccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctctctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacggacttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccactgagacaaatcctaggctcctgggaggccctggcagaagccagaacacatggctgggcctttccagcccaacccactgtcttgcagtggacggagagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaagccctttggggacaagggctgcttccagttcttggatggcgttctcctatctaccttccttcaactgctctgcatataataagcactcaataaatgctcatttgccaataa

SEQ ID NO: 108400 - DNA, 1762 bp, Homo sapiens
  Payload ID: 1297
  Gene Symbol: AQP2
  Gene Name: aquaporin 2 (collecting duct)
  ENST ID: ENST00000551526
  CDS Start-End: 91-762
cttgagaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttgggatccattacaccggctgctctatgaatcctgcccgctccctggctccagctgtcgtcactggcaaatttgatgaccactgggtcttctggatcggacccctggtggggagccctgagcctggcaggtcccctgccctgaggctgtgagcagctagtggtggcttctccagcctttttcagggaactgggaacttaggggactgagctggggagggaggcaggtgggtggtaagagggaaactctggagagcctgcacccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctctctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacggacttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccact

SEQ ID NO: 108401 - DNA, 809 bp, Homo sapiens
  Payload ID: 1297
  Gene Symbol: AQP2
  Gene Name: aquaporin 2 (collecting duct)
  ENST ID: ENST00000550862
  CDS Start-End: 78-809
gcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttggggtaggtcatggccatgggttccagcctccctggaggaacagacacacagaccactccagagacagacacagagaccccaagagggacacatacacagaactctcaagaggaacagacaccccagagatccattacaccggctgctctatgaatcctgcccgctccctggctccagctgtcgtcactggcaaatttgatgaccactgg

SEQ ID NO: 108402 - DNA, 1849 bp, Homo sapiens
  Payload ID: 1298
  Gene Symbol: AQP3
  Gene Name: aquaporin 3 (Gill blood group)
  Uniprot ID: Q92482
  ENST ID: ENST00000297991
  CDS Start-End: 82-960
ccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctcca

SEQ ID NO: 108403 - DNA, 5274 bp, Homo sapiens
  Payload ID: 1299
  Gene Symbol: AQP4
  Gene Name: aquaporin 4
  Uniprot ID: P55087
  ENST ID: ENST00000383168
  CDS Start-End: 130-1101
cacatggtgcagaatctttccacccctaacactccaaaaacccaatcagacaagtggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagctgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacatta

SEQ ID NO: 108404 - DNA, 567 bp, Homo sapiens
  Payload ID: 1299
  Gene Symbol: AQP4
  Gene Name: aquaporin 4
  ENST ID: ENST00000383170
  CDS Start-End: 83-379
agacaagtggccgtaatctgactcccagcacacagggagctgcggggcaggcaatgagagctgcactctggctggggaaggcatgagtgacagacccacagcaaggcggtggggtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgag

SEQ ID NO: 108405 - DNA, 1169 bp, Homo sapiens
  Payload ID: 1299
  Gene Symbol: AQP4
  Gene Name: aquaporin 4
  Uniprot ID: P55087
  ENST ID: ENST00000440832
  CDS Start-End: 264-1169
gttcccatcgcccttgctagtcaccagaagctcctctcccctcaatgagttcactttctcaaaagacagccttcagcaccctggtttcctagaaggcttccccctaatccagagtctggggggagggggagattttcagaatgccatttcaaagcaatcaaatgcaaagctagaaaagacgaccccccccccccacgcacaccttgttttaatgctttatgttcgaaattaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatga

SEQ ID NO: 108406 - DNA, 575 bp, Homo sapiens
  Payload ID: 1299
  Gene Symbol: AQP4
  Gene Name: aquaporin 4
  ENST ID: ENST00000578776
  CDS Start-End: 19-575
actctggctggggaaggcatgagtgacagacccacagcaaggcggtggggcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattg

SEQ ID NO: 108407 - DNA, 1586 bp, Homo sapiens
  Payload ID: 1299
  Gene Symbol: AQP4
  Gene Name: aquaporin 4
  Uniprot ID: P55087
  ENST ID: ENST00000581374
  CDS Start-End: 287-1192
cctttctagggacagtttggataattttccgtgaaactggatgatctttgaatattaaatgaaaggagactagaataacagtctcttgactattcatgaaggagctttagcagaagcattctttcttggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttat

SEQ ID NO: 108408 - DNA, 891 bp, Homo sapiens
  Payload ID: 1299
  Gene Symbol: AQP4
  Gene Name: aquaporin 4
  ENST ID: ENST00000622234
  CDS Start-End: 1-891
atgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatga

SEQ ID NO: 108409 - DNA, 1450 bp, Homo sapiens
  Payload ID: 1300
  Gene Symbol: AQP5
  Gene Name: aquaporin 5
  Uniprot ID: P55064
  ENST ID: ENST00000293599
  CDS Start-End: 149-946
ccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggaatctacttcactggctgctccatgaacccagcccgctcttttggccctgcggtggtcatgaatcggttcagccccgctcactgggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggcgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactca

SEQ ID NO: 108410 - DNA, 1398 bp, Homo sapiens
  Payload ID: 1301
  Gene Symbol: AQP6
  Gene Name: aquaporin 6, kidney specific
  Uniprot ID: Q13520
  ENST ID: ENST00000315520
  CDS Start-End: 338-1186
tcatcgtaggaggttccagctcagtgcccagagacagcccccacatcccaccccatcaggtcagctcaggctggagcaggcatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagccagggtcagccagagacaggacaccagaagagacaggagatcagagaccagaggaacagagaagaggccccagagcaaggcaaggaacggccaaggcaccaggacatggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccacttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatccctggcattacgtttctaggtagaatctgggagtgaatttgtcccattccctctctgtagggcttccccacctctcg

SEQ ID NO: 108411 - DNA, 849 bp, Homo sapiens
  Payload ID: 1301
  Gene Symbol: AQP6
  Gene Name: aquaporin 6, kidney specific
  ENST ID: ENST00000551733
  CDS Start-End: 499-825
ggaggacacagggagtccctcatgcttgagtcccctggggccaccttgaggcagcctatcccaatgcatccccgccccgctatccgggtggggcgcagaagagaggggagcccttctccgctcagtctccaggagactcaggcacgtttatagggaagaagtcaagagaaggggaagcctgaaagccacaggtgagactgggaaaggccaagagagggtcccagtcactcaaagggagccagaagtccaaggagggtcccccgaccccgacttgtacactggagaagggctgcccctacttcaaggccacagggcagctgcaggccacagtgtccacagcgtccttggtaaagtcgactgtattcacatctgcattctgtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccacttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgccc

SEQ ID NO: 108412 - DNA, 2245 bp, Homo sapiens
  Payload ID: 1301
  Gene Symbol: AQP6
  Gene Name: aquaporin 6, kidney specific
  Uniprot ID: Q13520
  ENST ID: ENST00000615425
  CDS Start-End: 1-849
atggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccacttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgcccttgggcttcctgccttgcaggacctgcctggaggttctccctggcattacgtttctaggtagaatctgggagtgaatttgtcccattccctctctgtagggcttccccacctctcggtgggacagagcagaggaaggcaggggatttaggatcgccctcccatcctctcacccactggaccccgtaggagtcctgaccccagatgcccaagtcttgggggagaaaggaatgggagcccagacagccactctgcttagacatgggagctatagggacctcagggagccccagcttcttacccacccaggaaacccttggtccagagaggacaggctttctggaggaatcaggccctgggacagcctctgagctcctgggggtgtttctctgaccttgggtgtggttttgggggctatatttcctccttcagactgggggcttcctgaggacagagactgctctaccaatagatctttgtttgttttgagacagaatcttgatctgttacccaggctggagtgcagtggcatgatctcggctcactgcaacctctacctcctgggttcaagggattctcctgcctcagcctcccaagtagctgggattacaggcgcctgccaccacgcccagctaattttttgtatttttagtagagatggggtttcatcatattggtcagggtggtctcaaactcctgacctgaggcgatctgcccacctcggcctcccaaagtgctgggattacaggcgtgagccaccgtgcccggcctctcccaataggtctttattcctcaatcctccaaatgctctggagaggcccccacccttgagaagaactgacacagagaagaacattttctcaggctcgtagagaggtgggatagaggaagggaggtttgagccagacaggcctttcccagggaagcctcctcccaggtgcttgccccagctcccaccccacagcccactctcaggcaggaacaatcctcagaggggaagtgcccatctagccattgactcatgacctgggtcaaagaagccgtctccaggctctctgtcagcattacaggatccccagaaagctgttgaataagccctaagggtggtaggaacccaggagggacccaggaaactaagatttgagattcagtgcctctgaaagactaccaaaatctaagttggtttaatagttaaaagctgctgtagatttattctgcccacaacttgggggtcctttctggatctcggcttctccagctgtaaaatggacacacaatcctcctccagggactgctgtgaaatcaagaaatcggaaaatactttcagaagttaaaatgctagaaaaacaaccccaataaatgatgattattgtt

SEQ ID NO: 108413 - DNA, 829 bp, Homo sapiens
  Payload ID: 1301
  Gene Symbol: AQP6
  Gene Name: aquaporin 6, kidney specific
  ENST ID: ENST00000618286
  CDS Start-End: 338-829
tcatcgtaggaggttccagctcagtgcccagagacagcccccacatcccaccccatcaggtcagctcaggctggagcaggcatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagccagggtcagccagagacaggacaccagaagagacaggagatcagagaccagaggaacagagaagaggccccagagcaaggcaaggaacggccaaggcaccaggacatggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggctccacccacgtcctctgctctccgactgttcccaagttcttccctccacctcgaggcctgcctcactcgccccttctccatttcgtaa

SEQ ID NO: 108414 - DNA, 1256 bp, Homo sapiens
  Payload ID: 1302
  Gene Symbol: AQP7
  Gene Name: aquaporin 7
  Uniprot ID: O14520
  ENST ID: ENST00000297988
  CDS Start-End: 173-1201
ggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 108415 - DNA, 1062 bp, Homo sapiens
  Payload ID: 1302
  Gene Symbol: AQP7
  Gene Name: aquaporin 7
  ENST ID: ENST00000379506
  CDS Start-End: 18-788
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgag

SEQ ID NO: 108416 - DNA, 2879 bp, Homo sapiens
  Payload ID: 1302
  Gene Symbol: AQP7
  Gene Name: aquaporin 7
  ENST ID: ENST00000379507
  CDS Start-End: 28-1053
aggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacagcagtacccccacttcctgggggcctcctgtggttgggcttccctcctgggttcttacaggagctccagggctatgtcttagcccaaggtgtagaggtgaggcacctcaagtctttcatgccctgggaactggggtgccccagggggagaatggggaagagatgacctgcgccctcagtaggaacagggtgagatgaaagaacgacagaatgagggattttcaggcacgggggaaggaagggtggttttggggaacagaccgtagctgactggttgggggccggctttggaaatactttgaggggatcctgagattggactctagactctcccctggttcttcccttccctgagttctggccggttcttggaccagacaaggcaaggcccaagaatgtagatcagaattttttagcctttttttcattagttccttccctagtattcttctagattttttttttcttaatcacatgaaattttaataccacagatgtactatatatctgtttatgttctgtatatgttctgtgctttatacataaaaaagagtaagatttttttttcacctccccttttaagaatcagttttaattcccttgagaatgcttgttatagattgaaggctgttaaggggttgggctcctctttcttcttcctggtgccagagtgctcccacatgaaggaataggaaaggaagatgcaaagagggaaatccttcgaccacatgaagacacaggaagaggcctcatagggctccaagggctccagggaagcaggtgcagaggttgggtggggtgaggggccaggatccactgaccctggggccaggcaggaatcactctgttgcctggggctcagaaggcagcatcacccatggttcctgtccttgctcatgcattttgcctttcaataattattgtgcatctactgtgtgcaggccctgcctggacactggggatgcgcagtggatgcgctgggctctgcctttgagggttgcagtttaatgggggacaggtaattatatggaagaaggtgagtgcagagtgggaggcttggaggctgtggggctcggggtaggggagctcacatccagcctctgggccaaggccaggaggcttcccagaggaggagacagagcagggtatggtggtggggggtgtcctttttgggggtgggagctgcactttacagtttgaggggatgggcagaggaggctgggcttcgttctggaggtggggacacggtgaggtgaggtttagaaagcacacctgagccgcagtgtgtaggatgctggaaatggtggagatgggcctgcgaaagtgatgacccaggagcagcagccgggcacctaacaatgggtcagcaccgtgggcgtggagacgagagcggggattgatcaataccggagaagtacaatgtacaggacttgggttccatttggatggagtgggtgagggagagggaggagtcagaaatggcttccggtttccagcttgggcctggggattggagatgtccccactgagagtagggcacaagtgaggaaatggtttggagaggaagataagttacatcatggacatgctgagtctgagttgcctatgggacttggaatggggggtggcaaaatgtgtgtgatcttgagcaagatattcaacccttctgggccttggtcttcttatttgtaaaatggcgataagaatattacttcccatttgtgttgctgtgaatattaaatgcgctaccacatgtaaaatgttgagaatca

SEQ ID NO: 108417 - DNA, 1068 bp, Homo sapiens
  Payload ID: 1302
  Gene Symbol: AQP7
  Gene Name: aquaporin 7
  ENST ID: ENST00000377425
  CDS Start-End: 215-865
ggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgaca

SEQ ID NO: 108418 - DNA, 675 bp, Homo sapiens
  Payload ID: 1302
  Gene Symbol: AQP7
  Gene Name: aquaporin 7
  ENST ID: ENST00000439678
  CDS Start-End: 167-675
gagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcagcaatggggagaactggtggtgggtgccagtggtggcaccact

SEQ ID NO: 108419 - DNA, 998 bp, Homo sapiens
  Payload ID: 1302
  Gene Symbol: AQP7
  Gene Name: aquaporin 7
  Uniprot ID: O14520
  ENST ID: ENST00000447660
  CDS Start-End: 389-886
aaagcgccgatgagctgttctggagcacggggcccagcacagggtgagaggtgagatgcctgtggggaaatccaggagatagttaaacacatgcaaggggctggagctcaggagaggcttggtctggaaggaaaaagttgaagttcatcacaacacaggtggtagttgtcaatactgtccagagacagtgtacagaaagagaaaaggatgggttgaggacagagccctgaggaatgaagaagggcatgcaaaggagcctgagaaggaacggtcagagaggtgggaggagaaccagagcagactgcatgacagaggggggcagtggttccaccaggaagaagccgtcagcggcgtgggcagcggcagatgggccacgcgaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaaca

SEQ ID NO: 108420 - DNA, 1668 bp, Homo sapiens
  Payload ID: 1302
  Gene Symbol: AQP7
  Gene Name: aquaporin 7
  ENST ID: ENST00000537089
  CDS Start-End: 168-323
tggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtcttggcccgaggtggatgagggtgctgtcctgggcatcagccccctcagcaggcctctgcctcttgcctgcagcaatggggagaactggtggtgggtgccagtggtggcaccacttctgggtgcctatctaggtggcatcatctacctggtcttcattggctccaccatcccacgggagcccctgaaattggaggattctgtggcgtatgaagaccacgggataaccgtattgcccaagatgggatctcatgaacccacgatctctcccctcacccccgtctctgtgagccctgccaacagatcttcagtccaccctgccccacccttacatgaatccatggccctagagcacttctaagcagagattatttgtgatcccatccattccccaataaagcaaggcttgtccgacagcagtacccccacttcctgggggcctcctgtggttgggcttccctcctgggttcttacaggagctccagggctatgtcttagcccaaggtgtagaggtgaggcacctcaagtctttcatgccctgggaactggggtgccccagggggagaatggggaagagatgacctgcgccctcagtagga

SEQ ID NO: 108421 - DNA, 575 bp, Homo sapiens
  Payload ID: 1302
  Gene Symbol: AQP7
  Gene Name: aquaporin 7
  ENST ID: ENST00000625109
  CDS Start-End: 334-575
aactcggtctccacggcactgctggccggacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggcgtggctgaccgggatgctccagctgtgtctcttcgccatcacggaccaggagaacaacccagcactgccaggaacagaggcgctggtgataggcat

SEQ ID NO: 108422 - DNA, 1479 bp, Homo sapiens
  Payload ID: 1302
  Gene Symbol: AQP7
  Gene Name: aquaporin 7
  ENST ID: ENST00000624890
  CDS Start-End: 150-275
atagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcgaggcttgttggcaccgtggattgcactttcagctccccacccgcccatctgcaaagtggcctcattggtgtgccatttttactggtccagtcccaactagaaggggcatggcctggccatctaccccagttcctctccatgtccccgtggctctcaagtgtctccaattccagctgtcccagctgccctgcgcaagaggaggcgtgtgtgggcgaggctgctgggttacctattaactcagctgggagttgaagagccgatgggcagcaggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgact

SEQ ID NO: 108423 - DNA, 1026 bp, Homo sapiens
  Payload ID: 1302
  Gene Symbol: AQP7
  Gene Name: aquaporin 7
  ENST ID: ENST00000624005
  CDS Start-End: 336-491
agaactcggtctccacggcactgctggccggacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggagcccacatgaacgcagctgtgacctttgctaactgtgcgctgggccgcgtgccctggaggaagtttccggtctatgtgctggggcagttcctgggctccttcctggcggctgccaccatctacagtctcttctacagcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtc

SEQ ID NO: 108424 - DNA, 585 bp, Homo sapiens
  Payload ID: 1302
  Gene Symbol: AQP7
  Gene Name: aquaporin 7
  ENST ID: ENST00000625032
  CDS Start-End: 436-585
gatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagagtcctggacagtcgcagcttaagttagcagcaagaggacttgaggttaaaggtatagcacgcaaatatgaggctggagccactgagtagaggctgagggcatctccacagtccaaagccgggctgcagacacggaagcatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatgagagaa

SEQ ID NO: 108425 - DNA, 1270 bp, Homo sapiens
  Payload ID: 1302
  Gene Symbol: AQP7
  Gene Name: aquaporin 7
  ENST ID: ENST00000624075
  CDS Start-End: 240-1013
cttactgacctctcccctggaggagcaggagcagcgctcgaggccgccctgggagagctgagaggcaggctctggactggggacacagggatagctgagccccagctgggggtggaagctgagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatggtattcggccttggttccgtggcccatatggttctaaataaaaaatatgggagctaccttggtgtcaacttgggttttggcttcggagtcaccatgggagtgcacgtggcaggccgcatctctggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggcagcacaggagggtcctgctgagcccccaggtagcctggggagcaggagtgagtcccaacatttccccaggccagtacagatacagatcctgcacctgcactgagtgtcaacgctgtccctgaattgggctgaggctgaccagggccctgggttgggggtgtttcctggggtagcctggggatgactcctctgctcaacctgtctt

SEQ ID NO: 108426 - DNA, 973 bp, Homo sapiens
  Payload ID: 1302
  Gene Symbol: AQP7
  Gene Name: aquaporin 7
  ENST ID: ENST00000624420
  CDS Start-End: 120-377
gagccagggacagtcacggaggaacaagatcaagatgcgctgtaactgagaagcccccaaggcggaggctgagaatcagagacatttcagcagacatctacaaatctgaaagacaaaacatggttcaagcatccgggcacaggcggtccacccgtggctccaaaatggtctcctggtccgtgatagcaaagatccaggaaatactgcagaggaagatggtgcgagagttcctggccgagttcatgagcacatatgtcatgatgagagaaggtgatgactggtttggggttggagaagaaagcacatgtttgagagggctgtggaagacagaatcagggagactctgccagcagaagatgtgggcaaagcgccgatgagctgttctggagcacggggcccagcacagggtgagaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttgaggggtggggggtgatgtgaggggca

SEQ ID NO: 108427 - DNA, 875 bp, Homo sapiens
  Payload ID: 1302
  Gene Symbol: AQP7
  Gene Name: aquaporin 7
  ENST ID: ENST00000624095
  CDS Start-End: 51-305
gagttgaagagccgatgggcagcaggcagacttgagtctcctttctgtccatgggctcgggccactgtcttaggtccacccgtggctccaaaatggtctcctggtccgtgatagcaaagatccaggaaatactgcagaggaagatggtgcgagagttcctggccgagttcatgagcacatatgtcatgatgagagaaggtgatgactggtttggggttggagaagaaagcacatgtttgagagggctgtggaagacagaatcagggagactctgccagcagaagatgtgggcaaagcgccgatgagctgttctggagcacggggcccagcacagggtgagaggagcccacatgaacgcagctgtgacctttgctaactgtgcgctgggccgcgtgccctggaggaagtttccggtctatgtgctggggcagttcctgggctccttcctggcggctgccaccatctacagtctcttctacacggccattctccacttttcgggtggacagctgatggtgaccggtcccgtcgctacagctggcatttttgccacctaccttcctgatcacatgacattgtggcggggcttcctgaatgaggcgtggctgaccgggatgctccagctgtgtctcttcgccatcacggaccaggagaacaacccagcactgccaggaacagaggcgctggtgataggcatcctcgtggtcatcatcggggtgtcccttggcatgaacacaggatatgccatcaacccgtcccgggacctgcccccccgcatcttcaccttcattgctggttggggcaaacaggtcttcaggtactgcccctgcccaggcccattcctttgagtttttctgtgggtcccctgtgtgttg

SEQ ID NO: 108428 - DNA, 1359 bp, Homo sapiens
  Payload ID: 1303
  Gene Symbol: AQP8
  Gene Name: aquaporin 8
  Uniprot ID: O94778
  ENST ID: ENST00000219660
  CDS Start-End: 126-911
aaaggggcagagcccatagtgtgatcagcaggtcctgtccctaggagataagagtatcttgcacagcaggtgcaggtttcccagcagctcaggcaagagtccgatgtttgtgccatctgatcctgatgtctggagagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttcttgcttgattgctttgttgggggcctggccacttccttgcttctcaagctgacaattctcactttgcaataaatagtccagtgtttccttccacgtgctca

SEQ ID NO: 108429 - DNA, 1276 bp, Homo sapiens
  Payload ID: 1303
  Gene Symbol: AQP8
  Gene Name: aquaporin 8
  ENST ID: ENST00000566125
  CDS Start-End: 69-836
tgtctgtgaaggatcgtcatctatacactcagtcctggctcaggctgtcacggtgactgcagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttcttgcttgattgctttgttgggggcctggccacttccttgcttctcaagctgacaattctcactttgcaataaatagtccagtgtttccttcca

SEQ ID NO: 108430 - DNA, 3034 bp, Homo sapiens
  Payload ID: 1304
  Gene Symbol: AQP9
  Gene Name: aquaporin 9
  Uniprot ID: O43315
  ENST ID: ENST00000219919
  CDS Start-End: 371-1258
actgtgatttggcaacacaactggcacatctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 108431 - DNA, 2803 bp, Homo sapiens
  Payload ID: 1304
  Gene Symbol: AQP9
  Gene Name: aquaporin 9
  Uniprot ID: O43315
  ENST ID: ENST00000536493
  CDS Start-End: 186-1073
ccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttg

SEQ ID NO: 108432 - DNA, 1334 bp, Homo sapiens
  Payload ID: 1304
  Gene Symbol: AQP9
  Gene Name: aquaporin 9
  ENST ID: ENST00000558772
  CDS Start-End: 198-890
aaaatcttttctggaccagggcccgtcactgtgatttggcaacacaactggcacatctcttttctcatctcttgaaaaaaaccaacagagaaaaaagtaccttgagaataaaggtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggt

SEQ ID NO: 108433 - DNA, 9694 bp, Homo sapiens
  Payload ID: 1305
  Gene Symbol: AQR
  Gene Name: aquarius intron-binding spliceosomal factor
  Uniprot ID: O60306
  ENST ID: ENST00000156471
  CDS Start-End: 227-4684
aacgcctgcatgaacttccggctacacgccattccgcttcccgaggaacgcttgggctgttgtacgggttccctacgggactctgaaggctgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccggaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacaaggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgagaggagtgaaataccaaggacgcgatactaggaaacccaggtctatttgttatcagagtaaggatcaagccagatagcctgttatgtaatttctccgataaaagattttgaaagcaggtgctgtgggcatctgtatggggaatcgcactcatagaattattttcatttgtaaatatttggtatcaggccaagcaagggaaagaagctttactgtattaccatctttcctggaaaagattgatttttctctctcccttaggggatatgaggtatgatacctgcaaccaaaataagctggctgttaagtgctctctccttaactattgtccaagcaatgtacatcactcttgcctagatgagtgaccatacttttttctttgctgcttggtttttctatcactaaaaagcaaatttaggtggaagatggatgggtaagtcctttgtccttgtcaaaagaatttagaaagggtaaaggtggtgggatttgaattcttttaaacggtttattcattggaaaggcaagtgagtggcagttgactgtagaatcttgggaatttttgaaggaatttaagagctgtacttattttaaataatgaggaaacaatcagagagacttaaccagggtggcaactatggaagagtgggggtagaatccaagtctacagttctacggcactgctttgtttattttttcaatcaagcacacatgagggattgcttaataaattcaagagttttctatatagtttgggattactacagacacaggtactctagccatgtgactatttcagattagtgttcccattgctctccatcctatttttcatatctaaatgtgtcatgattttagaatctctttgtaaagaaaaccaaaaagagccatgcccaaaagaatgagcatgaaatgaagcaattcaagtatttagaatttcttcttcttttttttttttttttttcaaaattctgagttaagaaagttcattgccaacagttgaggataaatagctctattgatttaggcaaatgaatgagaagatttaaacatcatcaagactcccaaagttggtgtaataaaagttgagatgttttgctagatgctgagagaaaaggcataaataggccatttgtgctcctgtaaacaaatgaaattttgtaatgatcaagagacagcaagatattataaaacacactttggactcatcgagacctggctcagagttgtacctaatttgcttatcagcatttggttagaccttagacaaattttataacctctctaagcccattttctttatctgtaaataaaggaaaaagatctgtttggatttgggacaggagagttgtctgttttatagggtaatgtttatgaaaataatttatcacctaggtacttagtaaataccagtttctgtctctgtttttcttcaaagctttgttgacaatgtaggatattgccaactaatcctttgacttgagtgcttagccatgccccaatccaggcagcatgaagaatgatcaagaaggggacacctagtggcagttgacctttgaggatctatctaggatcaggttactgatttgggacctctgaatcagtacatcataacatcgagagtgatctctgccaaaattaaaattctgtcagaacagtataagcagaaggaagacattaggtctttctgaaatatggagctgataacttctatcagttctgaattctgtactgtcccacccccaaatcatctatattgttgcatgtgcttagctttgtgccttgaattgctatttcctttttatcttgcactcagatggtatttttagagatgtttcttcaatcaaaacaagataaagttaaaaaaaaaaaaaaaacagtgacccttttgcataagccagaagagcagtgccttgcttcctgtgaaaaatgcttggcagttagcctgtgtaattatttagcaatcatgttaatagatgtttaagaataatggaactggagctgtactgagccaaggatggaaatgaagacatgtgagactattttttcttcatccaccgatactcttcagttacaaggatttaatttaaaagggttttaattaaatggaatccagaagctttggacgctccagtttttcttcttagagacaaaccctagctcagtttcctggagcttgactcagaatgcagcatggtactccggactgacagtgtgccagctttattcacttatctctctaccttttggcttgcgtttatttcagggctgcctgacattttgaccttatgtacaaagatggccgatacgattatttttcatcatatattacagaaaatactactcttgaaaaatactctgagaaatatgttctatggtcagataagtttgggaaacagtgaattattgttcctcctttgcagaatcacaatgcactgttagctaattaaagactctcagatgtcccactggaaagaatcatgtttagctttgtttaacctagcatttcccaaacttattagagcataaaactttgtttttgtttttttttaataagataggtagctatttccttagaacacagtttgggaaactttttgttcatttgttttaataagataccttaggtagctatttccttagaacacgagccgggtgcagtggctcacgcctgtaatcccagcactttgggaggcccaggcgggcggatcacctgaggtcaggagatcgagatcatccggcccaacatggtgaaaccccgtctctactaaaaagacaaaaattagccagccatggtggcaggcacctgtagtcctagctactgtggaggctgaggcaggagaatcacttgaacccgggatggggaggttgcagtgagctgagatggcgccactgtactccagcctgggcgacgagcaaaaactccttcaaaaaaaaaaaaaaaacataacttaggtagctatttccttgggaaccaatatctttacattggctagaactgtgaatcgccctttaaagataaagccccaaaatacattttttttccctacaggtaaccagagggtgaagtaacagccgaagaggaaaccagaagtgaagtgatttgtacaaaatgtcgtagtgtaatttattgagtgtcatgtggtattaatcgcaacatcctgaaaatgcaaatgaataaaagtttggtcaatgtaccatgacattccttcatgtgagcctcctaagaaaaggtcactgagcattctctgtttacattttaattttagactccagaatttcacactaagtttttcttctcatttcttatgcagtaaaagaagagtttgtatttccaa

SEQ ID NO: 108434 - DNA, 5722 bp, Homo sapiens
  Payload ID: 1305
  Gene Symbol: AQR
  Gene Name: aquarius intron-binding spliceosomal factor
  ENST ID: ENST00000543879
  CDS Start-End: 121-2061
ggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggtatggtgacctatatttttgaaagagacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaaggtaaaagagacaggaaaaaaaatcattcccatttaaggacatttgttccatgatccaagtatttgtgaatagcttttgtgtagactattagcattcttggctatccaggaacttggctatccataaatccaaaagcacttttgtcgacttctgcaagagatgtgaatggaccaaataatttatttccttcatttcattcattaatattaatttaagtaacttataatctaaaggcttcttttcattgtcccttctcctttcttcatgtccccaaaagatatacagttaatataattttaaaatctaaaaataaagtgaacaagaggagaacacaccaattcttacttcataaaggatgcaggccccatctcatagttacccccaaatgtcctcaatttttagtcttccttgattttttaatttaagggataaagatagcattgacctcagagagcgtaatagaactctcatttttgtagtaccttcagtcttctgacccttggttacttgaagtagggaagctaaggttgaaagagcattattgcttaaaagatgagccaaaatggctaacatgaaaatttaaaagaagcacagaaacagaaacctccttatgtatattaaaagagattttacactgctaatattttctgtttgtgggggaatttgtctttggaaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccggaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttctta

SEQ ID NO: 108435 - DNA, 543 bp, Homo sapiens
  Payload ID: 1305
  Gene Symbol: AQR
  Gene Name: aquarius intron-binding spliceosomal factor
  ENST ID: ENST00000560117
  CDS Start-End: 2-543
gatgccaactggcctgcatgcctgtgtagtgccttcagatatactctgtcccccagtgccgagtagggccttgttaagaaaccgcttatcactaaatgatctgtcttccagctctacaatggcaagaatctgggacttactgtttatactgtttactttgcagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatca

SEQ ID NO: 108436 - DNA, 2358 bp, Homo sapiens
  Payload ID: 1306
  Gene Symbol: ALOX12
  Gene Name: arachidonate 12-lipoxygenase
  Uniprot ID: P18054
  ENST ID: ENST00000251535
  CDS Start-End: 54-2045
cccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggcccgcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactga

SEQ ID NO: 108437 - DNA, 443 bp, Homo sapiens
  Payload ID: 1306
  Gene Symbol: ALOX12
  Gene Name: arachidonate 12-lipoxygenase
  ENST ID: ENST00000480801
  CDS Start-End: 1-443
cgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcagggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccat

SEQ ID NO: 108438 - DNA, 2502 bp, Homo sapiens
  Payload ID: 1307
  Gene Symbol: ALOX12B
  Gene Name: arachidonate 12-lipoxygenase, 12R type
  Uniprot ID: O75342
  ENST ID: ENST00000319144
  CDS Start-End: 262-2367
cccagacacctgctcactcaccaccagctgggctccgcctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggcccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggaaagacaacagcagatgactcgctccccgtcctcctggagcacagaaaagaggagatcagagccaagcaggacttctaccactggcgagtctttcttcctggcctgcccagctatgtgcacattcccagttaccgccctccggtgcggaggcatcgcaaccccaaccggcctgagtggaatggctatattccgggattcccaattctcatcaactttaaggccaccaagttcctgaacttaaatctccgctactccttcctcaagacggcctccttcttcgtccgcctggggcccatggcactggctttcaaagtccgcggcctgttggactgcaaacattcgtggaagaggctgaaggacattaggaaaattttccctggcaagaaatctgtcgtctccgagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggagaaggggaacatttacctggccgactaccgcatcatggagggcatccccaccgtggagctcagcggccggaagcagcaccactgcgcccccctctgcctgctgcactttggacccgagggcaagatgatgcccatcgccatccagctcagccagacccctgggccagattgccccatcttcctgcccagtgattctgagtgggactggctgctagccaagacgtgggtacgctatgcggagttctacagccacgaggccatcgcccacctgctggagacacacctcattgctgaggccttctgcctggccttgctgaggaacctgcccatgtgccaccccctctacaagctcctcatcccccatacccgatacaccgtccagatcaacagcattggccgggccgttctcctcaatgagggggggctctctgccaagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtatgtgacggagatcatcacctattattacccgagtgacgcagccgtggagggtgatccggaattgcagtcttgggtgcaggaaatatttaaagagtgcctcctggggcgggagagctcaggcttccctaggtgcttgcgaaccgtgcctgagctgatccgatatgtcactatagtcatctacacctgctctgccaagcacgctgctgtcaacacaggccagatggagttcaccgcctggatgcccaacttcccagcgtccatgcggaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcatagaggcgttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacaccaaacaaacaaaaaaacaaaaaaccttcctttc

SEQ ID NO: 108439 - DNA, 2677 bp, Homo sapiens
  Payload ID: 1308
  Gene Symbol: ALOX15
  Gene Name: arachidonate 15-lipoxygenase
  Uniprot ID: P16050
  ENST ID: ENST00000293761
  CDS Start-End: 15-2003
catctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggc

SEQ ID NO: 108440 - DNA, 553 bp, Homo sapiens
  Payload ID: 1308
  Gene Symbol: ALOX15
  Gene Name: arachidonate 15-lipoxygenase
  ENST ID: ENST00000576394
  CDS Start-End: 225-553
actccctgctctcgccaggacaccgccttttggactggggctgaattctgccccttgaagctctgctccttggagctgggggccccagcggtaggcggagttgattggagacctgccacccacattccgaccccaagcgacctccgagagggcggggtctcaggctgggttatttagctcgtccacccttctccaccagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctga

SEQ ID NO: 108441 - DNA, 2784 bp, Homo sapiens
  Payload ID: 1308
  Gene Symbol: ALOX15
  Gene Name: arachidonate 15-lipoxygenase
  Uniprot ID: P16050
  ENST ID: ENST00000570836
  CDS Start-End: 98-2086
ttctgcaggcaacagggaggcagcggcttttatgctcaaaaggaatgagtcccagtggctggcacagagaagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaatatagagcatcaaaaaa

SEQ ID NO: 108442 - DNA, 581 bp, Homo sapiens
  Payload ID: 1308
  Gene Symbol: ALOX15
  Gene Name: arachidonate 15-lipoxygenase
  ENST ID: ENST00000572265
  CDS Start-End: 570-581
gtgaccacagggaggagaaagtgaaggcaggagcgcaccttcccacctgccgtccccgtcccctcagaaccgagtcctggggccacctgctcggcgcggtccctctctctctggctcagtccccgcaccccgatacgtctcctcctctcagaggctccgaggaagggcgtgggcgctggagggagcagggctcagccgggtgcccctcccgccaggccccaccggggctgagcctcttctgtcgcccgcaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggcc

SEQ ID NO: 108443 - DNA, 2422 bp, Homo sapiens
  Payload ID: 1308
  Gene Symbol: ALOX15
  Gene Name: arachidonate 15-lipoxygenase
  Uniprot ID: P16050
  ENST ID: ENST00000574640
  CDS Start-End: 285-2156
ctgcgtgttttcggtccaaatccttttctttttctccctcccgtcaagatagtggtttccactccctgctctcgccaggacaccgccttttggactggggctgaattctgccccttgaagctctgctccttggagctgggggccccagcggtaggcggagttgattggagacctgccacccacattccgaccccaagcgacctccgagagggcggggtctcaggctgggttatttagctcgtccacccttctccaccagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaa

SEQ ID NO: 108444 - DNA, 2605 bp, Homo sapiens
  Payload ID: 1309
  Gene Symbol: ALOX15B
  Gene Name: arachidonate 15-lipoxygenase, type B
  Uniprot ID: O15296
  ENST ID: ENST00000380173
  CDS Start-End: 117-2060
gtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctacc

SEQ ID NO: 108445 - DNA, 2739 bp, Homo sapiens
  Payload ID: 1309
  Gene Symbol: ALOX15B
  Gene Name: arachidonate 15-lipoxygenase, type B
  Uniprot ID: O15296
  ENST ID: ENST00000380183
  CDS Start-End: 140-2170
aaacggacgtgctttttagaggagtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaa

SEQ ID NO: 108446 - DNA, 2396 bp, Homo sapiens
  Payload ID: 1309
  Gene Symbol: ALOX15B
  Gene Name: arachidonate 15-lipoxygenase, type B
  ENST ID: ENST00000572022
  CDS Start-End: 123-2117
agaggagtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccacct

SEQ ID NO: 108447 - DNA, 1809 bp, Homo sapiens
  Payload ID: 1309
  Gene Symbol: ALOX15B
  Gene Name: arachidonate 15-lipoxygenase, type B
  Uniprot ID: O15296
  ENST ID: ENST00000573359
  CDS Start-End: 1-1809
atggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 108448 - DNA, 2506 bp, Homo sapiens
  Payload ID: 1310
  Gene Symbol: ALOX5
  Gene Name: arachidonate 5-lipoxygenase
  Uniprot ID: P09917
  ENST ID: ENST00000374391
  CDS Start-End: 54-2078
cctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaa

SEQ ID NO: 108449 - DNA, 2390 bp, Homo sapiens
  Payload ID: 1310
  Gene Symbol: ALOX5
  Gene Name: arachidonate 5-lipoxygenase
  Uniprot ID: P09917
  ENST ID: ENST00000542434
  CDS Start-End: 105-1958
ccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatg

SEQ ID NO: 108450 - DNA, 1945 bp, Homo sapiens
  Payload ID: 1310
  Gene Symbol: ALOX5
  Gene Name: arachidonate 5-lipoxygenase
  ENST ID: ENST00000622238
  CDS Start-End: 1-420
atgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgagatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctga

SEQ ID NO: 108451 - DNA, 2390 bp, Homo sapiens; identical to SEQ ID NO: 108449
  Payload ID: 1310
  Gene Symbol: ALOX5
  Gene Name: arachidonate 5-lipoxygenase
  Uniprot ID: P09917
  ENST ID: ENST00000622021
  CDS Start-End: 105-1958

SEQ ID NO: 108452 - DNA, 1945 bp, Homo sapiens; identical to SEQ ID NO: 108450
  Payload ID: 1310
  Gene Symbol: ALOX5
  Gene Name: arachidonate 5-lipoxygenase
  ENST ID: ENST00000612635
  CDS Start-End: 1-420

SEQ ID NO: 108453 - DNA, 2504 bp, Homo sapiens
  Payload ID: 1310
  Gene Symbol: ALOX5
  Gene Name: arachidonate 5-lipoxygenase
  Uniprot ID: P09917
  ENST ID: ENST00000610656
  CDS Start-End: 54-2078
cctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 108454 - DNA, 904 bp, Homo sapiens
  Payload ID: 1311
  Gene Symbol: ALOX5AP
  Gene Name: arachidonate 5-lipoxygenase-activating protein
  Uniprot ID: P20292
  ENST ID: ENST00000380490
  CDS Start-End: 99-584
aatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctga

SEQ ID NO: 108455 - DNA, 1224 bp, Homo sapiens
  Payload ID: 1311
  Gene Symbol: ALOX5AP
  Gene Name: arachidonate 5-lipoxygenase-activating protein
  ENST ID: ENST00000617770
  CDS Start-End: 249-905
tcctattatctgggcatttggaggtgaaggggtcacagctctggcaaagatggggttgaaagggcccggactccagggaggggcagctctgcatggcctgattcctgcaccccacctttgccccctcacacctcctctcatctcccgtttttgaagaggaggaccctgtcacatctggacaattctgcaagaactctgtagaactgacttcactgtgaaccaggctccagaagtcaacagaaacaaaaatgctcacatttaatcacgatgctccctggcatacacagaagactctgaaaacttctgaatttgggaaatcctttggcaccttggggcacattgggaacataagccatcagtgctgggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctg

SEQ ID NO: 108456 - DNA, 3053 bp, Homo sapiens
  Payload ID: 1312
  Gene Symbol: ALOXE3
  Gene Name: arachidonate lipoxygenase 3
  Uniprot ID: Q9BYJ1
  ENST ID: ENST00000318227
  CDS Start-End: 270-2801
acagatttggaagcagcgggtgaagctcgcctgctgctgattgagctttttctgcctcccgttcttagagcccccgccgaggctgcgacgcagggactgtaccatagtagaggctggaacagtgcggcgccggaaccggccgcgcggggccgctgcgggctatgggcttctctgagaggttcctccccagtccctagtggcccagatcccggacacctgggctcccgcccaggatcctgcaggcccagggcggtcctggagcggaaagaatgccacgcggggcattcagaccctgtttgccggcgctgtatttcgctttcctgacctgccctactccagagcagagaatgagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaa

SEQ ID NO: 108457 - DNA, 3362 bp, Homo sapiens
  Payload ID: 1312
  Gene Symbol: ALOXE3
  Gene Name: arachidonate lipoxygenase 3
  ENST ID: ENST00000380149
  CDS Start-End: 32-2635
gcaggtgccctgtgctcatctctgcctgggaatggggaggaacagatcttgggggacattggggagtgggcggacaagcactccagggcatcagtccgggccgctgaccaggcggagggcagtgtcccaattatacaggcgttacctccttttctccatctcagcatctgatccctccctccgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctca

SEQ ID NO: 108458 - DNA, 3203 bp, Homo sapiens
  Payload ID: 1312
  Gene Symbol: ALOXE3
  Gene Name: arachidonate lipoxygenase 3
  Uniprot ID: Q9BYJ1
  ENST ID: ENST00000448843
  CDS Start-End: 342-2477
cacggatgattcacacgtaggaatgcagtggaacccaggctcctgatatccatctgggtgagccagccagagggaccggctgtgtcagaggcaagcaaacaagtattagagtgcaagactgtgggcggagagaggaagcccgagccgccagcagggagcttcggagagagaaagcccaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaaccacccccaaataccacccaagaagaaagaaaggtccaagcatgaggaggaccagttcctcaggtcctccagacccttccatcctccctgttctcagttcacctgaaccttctcttctgcacatggagacttttgcagccaagatggctctgacatcatacaaactgggccctgagctgtgagagaccagcacagcagcgtccaggttaaaagccgctgaccaaagtccaatgcacaatagcccctccgaaaggaaggaaccgcttcacttcttgccccacttggggcagcctcttgttccagcctcttggaatgcccagcttgggtttctgagcttttctccctcatcctccccaatccccaaactccttctcctaccatgcctttctacgttctctttcttccaagcctagagccaccagcccagcttccttctctggaaaagcctggaaactgggcacagaaggactgtgtgcctgggtctaacatgtggtcccctttgtccctagcacctttaaggggaggggaagaattggagggcagcttgcctggacccctaacggctgttctcaggaacaggttcccaggcctggggtgtttgtggagatctgtctttctccaaagatttcatccaactcccctttcatcccactccctttcatcccatttttttctttctgtccttgagcccagtgagttcaataaaaaccaaaatatttggctctc

SEQ ID NO: 108459 - DNA, 2504 bp, Homo sapiens
  Payload ID: 1313
  Gene Symbol: ARAF
  Gene Name: A-Raf proto-oncogene, serine/threonine kinase
  ENST ID: ENST00000290277
  CDS Start-End: 212-2041
cttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagccctcaaggttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgttt

SEQ ID NO: 108460 - DNA, 1271 bp, Homo sapiens
  Payload ID: 1313
  Gene Symbol: ARAF
  Gene Name: A-Raf proto-oncogene, serine/threonine kinase
  Uniprot ID: P10398
  ENST ID: ENST00000377039
  CDS Start-End: 90-650
gagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaa

SEQ ID NO: 108461 - DNA, 2458 bp, Homo sapiens
  Payload ID: 1313
  Gene Symbol: ARAF
  Gene Name: A-Raf proto-oncogene, serine/threonine kinase
  Uniprot ID: P10398
  ENST ID: ENST00000377045
  CDS Start-End: 195-2015
tgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattc

SEQ ID NO: 108462 - DNA, 1913 bp, Homo sapiens
  Payload ID: 1314
  Gene Symbol: AANAT
  Gene Name: aralkylamine N-acetyltransferase
  Uniprot ID: Q16613
  ENST ID: ENST00000250615
  CDS Start-End: 1008-1766
atggaatccactaagaaggggcgagaccagtgaggattcaactaaagggagcgagaaggggcggggacccgggaggaggaagtggagtggccaccgaggaagaggggagtggtcggggtggggcacaggatggtggagagactgtcaacaacttttaatgagctcccttggcgtcctagcctagcccccaggcactgggagcattgcagaaagagaaagatactgtccctgtcctctaggtgtttccagtctagttggggagacaaaacaaatacacattaaatagataacaaacaactccaacttgtaaggctataatagatacgtgtagagcatatgtataatgcactgtattcaggaattccaagcagttcgaacgtcatgacccctcagaagttgacccagaagctggtgaaggaggcccagagaaagatacagggtgaggcacagtgaatctgctggaccagcttcaagaacaatatgtcagcctatccactgccacctcccacagctccagactcgtgggtgcttcctggatgtgaccagccatagaatttatcaccctggcaaggaccctggtacttggaagcttggagaaagtgattcagggctcttacccgcagtgggcaggactgctgacggctcccagctggattttcctgcaactgccctcaatgaagcaagctgttccacccaaggttgatgcaggacaaagagggtctcgctctgtcgcccaggctggagtgcagtggcgagtcactacagcctcgacctctccggctcaagccatcctcccgtctctgtctcccaaagtgctgggattacagcggtgagccactgtgcctggcttactgcctcatcttgttccctgaggttctagacctctagggtgttgtccggaaagaacagggccatgtggaagtcagcaaagagagaggccgattgaacagcaggctcttctcaggcatcgccaagtgactgattaggattggccaccagggggtgccatggagccacagtctatgaagggacagaagaggccttttgggggaccctggaggttgaaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctga

SEQ ID NO: 108463 - DNA, 1005 bp, Homo sapiens
  Payload ID: 1314
  Gene Symbol: AANAT
  Gene Name: aralkylamine N-acetyltransferase
  Uniprot ID: Q16613
  ENST ID: ENST00000392492
  CDS Start-End: 235-858
tacaaacctctaacagcaccacaggctgcccggggaacatctgctactacagccttgcagcccggagtcccggattttactggttcccgtgcctgcggacaggcccccagggctagcggctttgtggagggaacactgggtatcctctccacagtccaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgatccccgtctctgccctgggctcctcttagctcagctgagcatggagacagcagtttccagagagtggagagagcagggctaaataaagaggagataaggtggcttctcacggcctga

SEQ ID NO: 108464 - DNA, 796 bp, Homo sapiens
  Payload ID: 1314
  Gene Symbol: AANAT
  Gene Name: aralkylamine N-acetyltransferase
  ENST ID: ENST00000587798
  CDS Start-End: 86-364
cacagtccaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagacagtggacgcgaggcacagcgactaccagtcacccacctgagcctcctgccacagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtctgggggccacatagcccacctgcatgtgctggccgtgcaccgcgccttccggcagcagggcaggggccccatcctgctgtggcgctacctgcaccacctgggcagccagccggccgtgcgccgggccgcgctcatgtgcgaggacgcgctggtacccttctatgagaggttcagcttccacgccgtgggcccctgcgccatcaccgtgggctccctcaccttcatggagctccactgctccctgcggggccaccccttcctgcgcaggaacagcggctgctgaactgggctgcccacctggctgccaacatgat

SEQ ID NO: 108465 - DNA, 478 bp, Homo sapiens
  Payload ID: 1314
  Gene Symbol: AANAT
  Gene Name: aralkylamine N-acetyltransferase
  ENST ID: ENST00000585649
  CDS Start-End: 24-478
ctctggggcctgcctccctggagatgaggatgagacccctgtcccttgctgttctccaacaggtgctgggaggccctccttggcttaggaggacacttccaaagctggggcgccccaaggaggcaccagtggccagaatgtccacgcagagcacccaccccctgaaacctgaggccccacgtctgccacctgggatccccgagtccccgagctgtcagcggcgccacacactccctgccagtgagtttcgctgcctcaccccggaggacgctgtcagcgcctttgagatcgagcgtgaagccttcatctccgtcttgggcgtctgccccctgtacctggatgagatccggcacttcctgaccctatgtccagagctgtccctgggctggttcgaggagggctgccttgtggccttcatcatcggctcgctctgggacaaggagagactcatgcaggagtcactgacgctgcacaggtc

SEQ ID NO: 108466 - DNA, 5516 bp, Homo sapiens
  Payload ID: 1315
  Gene Symbol: AMZ1
  Gene Name: archaelysin family metallopeptidase 1
  Uniprot ID: Q400G9
  ENST ID: ENST00000312371
  CDS Start-End: 369-1865
gattggtgctgtgacctgcggcagcacagccgcctgcgttgagcgcccacggtgggctggactttgcactaggtgctgacaggaccggcagaggtggccactgccctcgtccccagcctgcactcctgggcgaaggctgacgctgaacagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccgtggccgtcccccgggtggcccatggacagcagcaggggctcccaggagtggccaggccctgcccgcccaccatgctgcagtgtagacccgcacaggagttcagcttcgggccccgggccttgaaggacgctctggtctccactgacgcagccctgcagcagctgtatgtgtccgccttctcccctgccgagcggctcttcctggccgaggcctacaacccgcagaggacgctcttctgcaccctgctcatccgcacgggcttcgactggctcctgagccgacccgaggctcccgaggacttccagaccttccacgcctccctgcagcaccggaagccccgcctggctcggaagcacatctacctacagccgatagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacgaagtgggcgtctgcagcttcgcccggttctcaggggaattcccgaagtcggggcccagcgcccctgatctggccctggtagaggcagcagcagacggccccgaggcccccctgcaggacaggggctgggccctgtgcttcagtgccctggggatggttcagtgctgcaaggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagccaggaggcgggggagccgtcagtgtgggaggacaccccgcctgccagcgccgactcgggcatgtgctgtgagagtgactcggagcccggcaccagtgtgtcggagcccctcacccctgatgccgggagtcacaccttcgcctcggggccagaggaagggctgagctacctggcagcctcagaggctccgctgccacctgggggccctgcggaggccatcaaggagcatgaacggtggctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaattaaaaaattagctggatgaagtggttcatgcctgtgttcccagctattcaggaggctgaggtgggaggattgcttgagcctaggaggtcgaggctgcagtgggatgtgatcataccactgtactgcagtctgggccacacagaaagactgtctccagaaaaaaaaaagttctttggagaagccacagaccacctgtcttcaggcgcctccttcaactcctgagtcccagccagccgctcccaggggcctgcacacatggagaggcctccctgatcctgggtgcttctcgtggagtacaagccggactgtgctgaggttgggacagagccccctcccctgcagaggcagaaggaagcagcgtgcgtcctgtctccttccaggctgtgggcctgcccttcagttatttatagctggagctggagaggctggctcagatgaggagtgaccccgggggcacacaggctccacactgccacccagcttccaaggctgagtctcctccctaacggggaagtgacggggttttgtctctatcatctcaggcgtcaaccacatgcacacacacactgtcacgttctgtggcgctaacagcatcctgatcctgacggacttcaccggggctctccaggcatctcttctgacaaacactgcaggaggtgagggtgtctgacgtgcactgagggcagaggcccccttattcctgaggcggctacagctcaccgtggggaagatcaactgtggtgatgtttttgggacagtttcttggcaaaggtggccgcgctgtcagtaccaagtagctggaggtggtgatcagatgatctgtctttcctttttttttcggtctagttctgtcagttgctgagagaggggtattattgccatggctgggcgtttgatctgtctccctttagttttgccggattttgcttcctgcactttgaagctcctttacgtccctgcacatttgattgttgtgtcttcctgaggaattgacccttttattgtcacacgtaccccctcagcctgtggtggagggtctctgggagagagacttccggttctgacagcggaatcccttcggagtgacgagggcggggtcacagctcgcgcaccctcatctggagagaggcaagaacagggcagcttggaccttttgtgggtgggtggctcacacggttatggagggcttctaagaaaaacaaaatacaaaactaaaactagaagggctatgcaggtgaggtgggctgaggcttccttgtgaatctgacattggtggaggccgactgaaggctcccggtcctggtcccactccgtgttgacttcagagaagcaaagatgcagctcagaagtagcattaggatcttcgtcccgttctcttttgcgtagcttcaaaaaggcgtaacagtgacctgggaggggagatgaagagctaggcctttcagaaagtgaccaatggaaggtgccggcagagcaccctgcagtaacagaaggtgaaagccggagcctggtggctgttgctgcaaacaaccacccaaaacttagtggcttaaaatcaccacagtctagctcatgaatctgtaacttgggcagagctcggtggagacggtttgcccctgtggctcgactggagtgttcgttcacacggctgccaagtggaatttggctgggaatctcaggccttggttcctgcccacgtgagactctccatggaggaggggcatcttcttaggaaggcagctgccataccgtgaggaaacccgacaaacagggcagccagagccagacagcaggctcctggtcccagtcccggaaaatgcaaagggacaagtatgtgttgatttcagagaagctcagatgtagcattaggaccttcatccatacccttctcttttgcatggcttctaaagggcatgacagtgacctgggaggtaactgtgccagaataaagaggggagacgaaaaaaagagggtcactttcagaaagggacctgggcttcctcacaatatggcggttgccctcctaaggtggacatcgggagggtcagatggaagctctgtggcctttcctaactcggcctcacgtcacagagcgtcacctttcctgcactccacggcggcagtgacaaggaccccaccccaggttcacggggaggggacgtggcagggaatgtgagacaacacaatattgctgtggccattcatgaacagtcagtcagccccactcggcgttcactgtggggatttggctggtgcacctgcgaggtggcctgacctgttttccgatttccttcatcttctgcaaaaggttaaccgctggagtgatgcgagattaaacagaggtgataaaaatagaatgcctggctcatgctgagggtgggagcccactggggttatgaccaaagcctcggcgctctctgtacccgtgtcctttgaccctcagctgtgatgtgtgtcccaaaaaagcgttttgaagtgggaaggagcaaaccactaaaaaaaactccttttatccgcagcgtttaccaacttgcagatgtcagtgaaattttttaagacagctgttagaaggactgttttgaaatgcaactttgaggaagagaaattggtttccctcctctcccccgtgttagccccaggttctgtctgtgctgtggtgaagagtgacttgggacagtcaccaggaaagacgcaaggcagaggagagagaatgagggctgccttctcgaggaaggtcacagctcacgaatctttctaaacttaagtgctgcagaagttgaactgagattaaatttagagatgatggtttccaagacacacagggccacggttctttcagtttttaaacacgtgcaaagtccactgaattgctttctcgtctcatctgtcagaagcccctgcattcacaaggatgggtcttccagcttgacgatgacctctcttcggagagcctcacccatcttggtaagccaagtcagcggggcctcatggagctaaaaatagtttcaggtcatgacagatgttatctgtattgctgtgtgtgcgatgagtctggggaagctaacacatgccttctgaagtggctagaatacacactcccacgtcacagccatgctatgatgaaggggtgagaagcagtgtcccctctgaggcaaatctctcttcaggcagccccgcagtcctcttccgaaatctcattcttttccctctcttcctccccaaaaagcccaaactcattgtcagagtggggagaggggagaagcagcatcctgactcctgtccatggtgtgaaccctgagggcacgggacagtgagtggagctctgccaccacccgtttccagagcatgggtgaggagggagggatgccgacctgttaatatttgcttcagacctttccccgatgaacgaaatctccaaaagccttaaacataaaatggcttagtcaa

SEQ ID NO: 108467 - DNA, 1862 bp, Homo sapiens
  Payload ID: 1315
  Gene Symbol: AMZ1
  Gene Name: archaelysin family metallopeptidase 1
  Uniprot ID: Q400G9
  ENST ID: ENST00000407112
  CDS Start-End: 314-1207
gatcctcccggcccaggccgagctgcccacgctgctgcccggggctcggtgcccggcgcggcctctgccggctccggcgggcgcgggactgcgagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccgtggccgtcccccgggtggcccatggacagcagcaggggctcccaggagtggccaggccctgcccgcccaccatgctgcagtgtagacccgcacaggagttcagcttcgggccccgggccttgaaggacgctctggtctccactgacgcagccctgcagcagctgtatgtgtccgccttctcccctgccgagcggctcttcctggccgaggcctacaacccgcagaggacgctcttctgcaccctgctcatccgcacgggcttcgactggctcctgagccgacccgaggctcccgaggacttccagaccttccacgcctccctgcagcaccggaagccccgcctggctcggaagcacatctacctacagccgatagacctgagcgaggagccggtgggaagctccctgctgcaccagctgtgcagctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagccaggaggcgggggagccgtcagtgtgggaggacaccccgcctgccagcgccgactcgggcatgtgctgtgagagtgactcggagcccggcaccagtgtgtcggagcccctcacccctgatgccgggagtcacaccttcgcctcggggccagaggaagggctgagctacctggcagcctcagaggctccgctgccacctgggggccctgcggaggccatcaaggagcatgaacggtggctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaattaaaaaattagctgg

SEQ ID NO: 108468 - DNA, 1722 bp, Homo sapiens
  Payload ID: 1316
  Gene Symbol: AMZ2
  Gene Name: archaelysin family metallopeptidase 2
  Uniprot ID: Q86W34
  ENST ID: ENST00000359783
  CDS Start-End: 656-1564
gggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctccttcccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcatt

SEQ ID NO: 108469 - DNA, 2402 bp, Homo sapiens
  Payload ID: 1316
  Gene Symbol: AMZ2
  Gene Name: archaelysin family metallopeptidase 2
  Uniprot ID: Q86W34
  ENST ID: ENST00000359904
  CDS Start-End: 1133-2215
aaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctccttcccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactcttt

SEQ ID NO: 108470 - DNA, 1378 bp, Homo sapiens
  Payload ID: 1316
  Gene Symbol: AMZ2
  Gene Name: archaelysin family metallopeptidase 2
  Uniprot ID: Q86W34
  ENST ID: ENST00000392720
  CDS Start-End: 111-1193
agtgcgaagggacgcggtgcgcatgcgcgtgagggctgccgcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactct

SEQ ID NO: 108471 - DNA, 897 bp, Homo sapiens
  Payload ID: 1316
  Gene Symbol: AMZ2
  Gene Name: archaelysin family metallopeptidase 2
  ENST ID: ENST00000584494
  CDS Start-End: 153-897
gctgccgcgggtgggtggtatcgaggcctgtcgggtcagggcggttcgcgggtgctgtcagagctgggccggggcccctaggcaggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcct

SEQ ID NO: 108472 - DNA, 895 bp, Homo sapiens
  Payload ID: 1316
  Gene Symbol: AMZ2
  Gene Name: archaelysin family metallopeptidase 2
  ENST ID: ENST00000577273
  CDS Start-End: 2-607
gatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaa

SEQ ID NO: 108473 - DNA, 713 bp, Homo sapiens
  Payload ID: 1316
  Gene Symbol: AMZ2
  Gene Name: archaelysin family metallopeptidase 2
  ENST ID: ENST00000580837
  CDS Start-End: 123-713
gcctgtcgggtcagggcggttcgcgggtgctgtcagagctgggccggggcccctagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtg

SEQ ID NO: 108474 - DNA, 829 bp, Homo sapiens
  Payload ID: 1316
  Gene Symbol: AMZ2
  Gene Name: archaelysin family metallopeptidase 2
  ENST ID: ENST00000580548
  CDS Start-End: 244-829
caggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcggcctcgtggtggaacatcggacccattcaagaggaaggatgaaagctctatataggaacacgatgtgaatggaagaaacctgtcattatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatg

SEQ ID NO: 108475 - DNA, 1339 bp, Homo sapiens
  Payload ID: 1316
  Gene Symbol: AMZ2
  Gene Name: archaelysin family metallopeptidase 2
  Uniprot ID: Q86W34
  ENST ID: ENST00000580753
  CDS Start-End: 87-1169
cgtggcgcagtgcgaagggacgcggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaa

SEQ ID NO: 108476 - DNA, 672 bp, Homo sapiens
  Payload ID: 1316
  Gene Symbol: AMZ2
  Gene Name: archaelysin family metallopeptidase 2
  ENST ID: ENST00000584837
  CDS Start-End: 8-672
ggtgcgcatgcgcgtgagggctgccgcggccaggcccagacatgtccgtccttgtaagttaaaagcttccatgggagccttccttcctaatcaagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaa

SEQ ID NO: 108477 - DNA, 783 bp, Homo sapiens
  Payload ID: 1316
  Gene Symbol: AMZ2
  Gene Name: archaelysin family metallopeptidase 2
  ENST ID: ENST00000584836
  CDS Start-End: 1-229
ggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggtaaatactggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgcc

SEQ ID NO: 108478 - DNA, 722 bp, Homo sapiens
  Payload ID: 1316
  Gene Symbol: AMZ2
  Gene Name: archaelysin family metallopeptidase 2
  ENST ID: ENST00000579724
  CDS Start-End: 103-722
gggctgccgcgggtgggtggtatcgaggcctgtcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcag

SEQ ID NO: 108479 - DNA, 845 bp, Homo sapiens
  Payload ID: 1316
  Gene Symbol: AMZ2
  Gene Name: archaelysin family metallopeptidase 2
  ENST ID: ENST00000584350
  CDS Start-End: 1-72
cgcagcatttatatacagtccattggtaaatactggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactc

SEQ ID NO: 108480 - DNA, 1492 bp, Homo sapiens
  Payload ID: 1316
  Gene Symbol: AMZ2
  Gene Name: archaelysin family metallopeptidase 2
  Uniprot ID: Q86W34
  ENST ID: ENST00000577866
  CDS Start-End: 289-1371
ccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagcctcgtggtggaacatcggacccattcaagaggaaggatgaaagctctatataggaacacgatgtgaatggaagaaacctgtcattatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaa

SEQ ID NO: 108481 - DNA, 2257 bp, Homo sapiens
  Payload ID: 1316
  Gene Symbol: AMZ2
  Gene Name: archaelysin family metallopeptidase 2
  Uniprot ID: Q86W34
  ENST ID: ENST00000577985
  CDS Start-End: 989-2071
aaattgcagaaatgatagggcttacattagttttgtttttatttgatgttgaagatctttgagtcacattagaaacgatgagtatttttcatgtggcactgatgagttaattcatattattattttttgagacagagtctctattgcccaggctggactgcagtggcacgatcacggcccactgcagcctcgacctcctgggctcagatgatcctcccatcttagcctgccaagtagctgggactacaagtgcacatcaccacatccggctaatttttttgtagatatggggttttgccatgatgtcgaagctgatttcagactcctaggctcaagtaatccttctgccttggcctcccaaagtgctgggattataagcgtgagccactgtgccaggccaatattattccccaaaagaaggaagttgggtgtgaggtcctgctcctgtggtcaccgtgaggttttttttttttgttttggactcttgcccaggctggagtgcagtggcacagtcatggctcactgcagcctcaagctcctgggctcaagtgattctcctgtctcagcctccctggtagctaggaccacagatgtgcacaactatgcccagggaatttttaaattttttgtagagacagggtctcaccatgttgcctgagctgttctcaaactcctggcctcaagcaatcctcctatcccaaagtgctgaaattacaggcatgagccaccacacctggccaccactagtttttgtaatgggagcaggttccatatgagatggaggaatggatttcatgattgtctttttaatttcttagatctccaagaaattggacatgaggaaaccactctaagtgtgaccactctaaagcattagcaatcagtcatttcactctagggagaaatcagagctgaaatatagaggataggtaaagtccccaatgtagatatgtatttttatatttgattacttgcttttttttgttagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 108482 - DNA, 1498 bp, Homo sapiens
  Payload ID: 1316
  Gene Symbol: AMZ2
  Gene Name: archaelysin family metallopeptidase 2
  Uniprot ID: Q86W34
  ENST ID: ENST00000612294
  CDS Start-End: 221-1303
ggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctttatcttctc

SEQ ID NO: 108483 - DNA, 3845 bp, Homo sapiens
  Payload ID: 1317
  Gene Symbol: ARCN1
  Gene Name: archain 1
  Uniprot ID: P48444
  ENST ID: ENST00000264028
  CDS Start-End: 96-1631
agcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 108484 - DNA, 4038 bp, Homo sapiens
  Payload ID: 1317
  Gene Symbol: ARCN1
  Gene Name: archain 1
  ENST ID: ENST00000359415
  CDS Start-End: 166-1824
gaagcggcagcggttcctgtcaagggggcagcaggtccagagctgctggtgctcccgttccccagaccctacccctatccccagtggagccggagtgcgggcgcgccccaccaccgccctcaccatgataacttgatttaaaacatcgtccagtgtacctgagagatggcagaatgtaatttggtggcaatcctaataagttctattgacaaccctttagataagaacttggataatggggggaattcatgcttggactttaggccactgaacagcttttctcagcctcaggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatga

SEQ ID NO: 108485 - DNA, 1709 bp, Homo sapiens
  Payload ID: 1317
  Gene Symbol: ARCN1
  Gene Name: archain 1
  Uniprot ID: P48444
  ENST ID: ENST00000392859
  CDS Start-End: 159-1430
gacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatg

SEQ ID NO: 108486 - DNA, 1669 bp, Homo sapiens
  Payload ID: 1317
  Gene Symbol: ARCN1
  Gene Name: archain 1
  ENST ID: ENST00000534182
  CDS Start-End: 113-364
gttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgagatgtttattggattattgactcactttggtgtctgcttgttgattcaggatgctgtaatgggacctaacattaaaaattaatgacatgttttttttaagagaaa

SEQ ID NO: 108487 - DNA, 2238 bp, Homo sapiens
  Payload ID: 1317
  Gene Symbol: ARCN1
  Gene Name: archain 1
  ENST ID: ENST00000614498
  CDS Start-End: 125-694
gaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatg

SEQ ID NO: 108488 - DNA, 2512 bp, Homo sapiens
  Payload ID: 1318
  Gene Symbol: ACAP1
  Gene Name: ArfGAP with coiled-coil, ankyrin repeat and PH domains 1
  Uniprot ID: Q15027
  ENST ID: ENST00000158762
  CDS Start-End: 207-2429
agcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcc

SEQ ID NO: 108489 - DNA, 870 bp, Homo sapiens
  Payload ID: 1318
  Gene Symbol: ACAP1
  Gene Name: ArfGAP with coiled-coil, ankyrin repeat and PH domains 1
  ENST ID: ENST00000570457
  CDS Start-End: 427-870
ccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgacagaccagatggacccaagctctcttcccatgaccccctctttcccagagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcc

SEQ ID NO: 108490 - DNA, 614 bp, Homo sapiens
  Payload ID: 1318
  Gene Symbol: ACAP1
  Gene Name: ArfGAP with coiled-coil, ankyrin repeat and PH domains 1
  ENST ID: ENST00000575425
  CDS Start-End: 310-614
agaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgca

SEQ ID NO: 108491 - DNA, 317 bp, Homo sapiens
  Payload ID: 1318
  Gene Symbol: ACAP1
  Gene Name: ArfGAP with coiled-coil, ankyrin repeat and PH domains 1
  ENST ID: ENST00000575415
  CDS Start-End: 102-236
ctcccaaagtgttgggattacaggcgtgagccaccgcgcccggccaaagatagtgtcgttcatttcttaattccctcctcttcaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctctt

SEQ ID NO: 108492 - DNA, 274 bp, Homo sapiens
  Payload ID: 1318
  Gene Symbol: ACAP1
  Gene Name: ArfGAP with coiled-coil, ankyrin repeat and PH domains 1
  ENST ID: ENST00000570504
  CDS Start-End: 58-192
gaaaggctgcgcgaagtgtgcactgggacgtggagtagaaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttc

SEQ ID NO: 108493 - DNA, 412 bp, Homo sapiens
  Payload ID: 1318
  Gene Symbol: ACAP1
  Gene Name: ArfGAP with coiled-coil, ankyrin repeat and PH domains 1
  ENST ID: ENST00000574499
  CDS Start-End: 133-330
ggagtagaaggcaggcgggagggcgggcagggtgcaaggatgcttggcccaccctgagaggcgtaattcgcccatcaacattgctgtcaggcatctttttagcactagacgtgaccccgggggtgggggcagatgaacggaacgcaacccagctcaaaggatgggaagttgtgggggaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttc

SEQ ID NO: 108494 - DNA, 320 bp, Homo sapiens
  Payload ID: 1318
  Gene Symbol: ACAP1
  Gene Name: ArfGAP with coiled-coil, ankyrin repeat and PH domains 1
  ENST ID: ENST00000571471
  CDS Start-End: 105-239
gctgacgccgaaacagaagcctgtgctgtggggcctcggaaaggggctgggccagcgccggggccaggctcgagaaaggctgcgcgaagctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctctt

SEQ ID NO: 108495 - DNA, 7160 bp, Homo sapiens
  Payload ID: 1319
  Gene Symbol: ACAP2
  Gene Name: ArfGAP with coiled-coil, ankyrin repeat and PH domains 2
  Uniprot ID: Q15057
  ENST ID: ENST00000326793
  CDS Start-End: 232-2568
cgtttccctgcggccagcgctctacttggggcgggaggaagaggggcgggactggggcctgactagtcgtcgccgtcttcgcggctgctatgaccagcgggcgaggcgcccttcgcagctccgcgcaacgctagtcgcggccgtgcgcccgccgtagccgtctgcgtcccagcgcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaaatcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggctttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaaatttgtccttttaaagatagttttgctgttgctcctagtgaaagaaaaatctctgtacaaaggagaaaaagaaccccacttattcttagttaatactaaaatatatagcaataaattgctgtttattttttctacatctattttgtgtacttgtacacagtgtacattcttttaaattatatcgtgtatatagctttagtattcggttacatgattcacagacccctgaattccaaaatattatggataaacattaccatttatatgctacaaattagtctgattccatctttgaaaatgtcttaaagtataaaataattaatttgctttttttttttttttttcccgagatggcgtcttgctgtgtcacccaggctggagtgcagtggcacgatctcagctcactgcagcctcctcctcttgggttcaagcaattctcctgcctcagcctcccgagtagctgggactacaggcacccgccaccattccgagctaatttctatatttttagtaaagacgggtttcaccattttggccaggttggtctcgaactcctgacctcaggtgatcagcctgctttagcctcccagagtgctgggattacaggcgtgagccaccgcacccagcctaatttgccttttgattccttcccattgttgtcaacaattaagtctattcttcttttagaaattatatgtaaatgatattattgatactctttctaaataagaggttttaaaatatataaaaactttatgatccaattatagataaattttctaacatttcccagtcactagggttttataagttgattaaacatcaaatcagaatctagccaagcaggaattatattgaaataagttcacattacagaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgatttgtagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggccattggtgcgtgtttcattcagatcacctctggaatctctgtggttgtgaaggcaattccttatgagactcttgcctcctgtggcttacgtgatgaattgttaatatggcagtaattaattagtatctacttaaatttagtggtcagaaatgtatttgaagtgccttaaagatgatcatggttcagaatatcttcagagaaagcaaaatctttaatattgcagggagcctagcaatacaagtacacatttctgtggcttgatttcttgaatatgctgagacccaatttggactacatttggcagaaatgatggagtaaacagcaaggctttaaattaaattaatagttacaaggtaggttggctcttaggtgaatttagccatgtcaactaatagcttttatatggtatgtaacaaatctgaattatgttatgctgtgaattattcagtgcattataagaaatcttagttaatcatgcttttgggcttcattagtcaatgtgattggccttttattttctttccataacttatctgctattattagtttcttattccttattattaatctgttagctcattatcattagcttactaacttgaaagttagattaatatcaaaataagaatagcagcactatgaagagttaataaaatgcaatttcatgttagagctagaataaaagtaattgagcagtcatttgcaaatgcttcattataacatttatgtgcttaagatttctaaggttttaaaaagttacctttaatacaatccttagaaactcagaaatttcctgatattcattagattatggtgtttgcctaatttataccggttttcactgtatattttaatgaactttgattggttacttttccagacatacagatttaatttggaatatgaactttggttcttcatgagtgcattttgaaaaagaaaaaaagtacacattcagaatctggccaatttaagtttgtattttaaaaatattttatgcatgttaagtatggtcgcagtaaatgaaattgtgtttaagactaaatttactaccgttttgaacagacattcccagatcattcttatattgtcagataacacttgtgtataatatcactttggatcatggacatgagctggaaaaatgatgtatttttgtagattgtatgtccagaatgactttagaaccgcatgatacggtggaaggagcactggactagtcgtcactaccctttttggattcagggctcctcacaattaaaatgagtgtaatgaaacaaggtgaaaatatagaagcatccctttgtatactgttttgctacttacagtgtacttggcattgctttatctcactggattctcatggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggcttagttctttca

SEQ ID NO: 108496 - DNA, 700 bp, Homo sapiens
  Payload ID: 1319
  Gene Symbol: ACAP2
  Gene Name: ArfGAP with coiled-coil, ankyrin repeat and PH domains 2
  ENST ID: ENST00000447662
  CDS Start-End: 59-208
gcggccgctcccgcggccccctcggctttgccagcgccgcctgcgaggcggaggcaggatgaagatgactgtggatttcgaggagtgtctgaaggactcgccccgcttcagatgccgtgagagcaggggcttgttttaccgcttgctgtttcctaagtctctagtacagtgcgtgacatccattctggagctgggaagtccaagataaagatgccagcagattagtgtctggtgagggccagctatctctgctttcaagatggcaccttgttgatgtgtcctcaatggcagaaggtggaagggcaaaaaagggaccattaggaccctttcttcagcctcttttataagagcactaatccattcatgaaggcggagccctcatgtcttcatcacttccccaaaggccccacctcttcatactgtgacaatggagatcaagtttcaacatgaattttggagagacacaaacattcaaaccatagcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaa

SEQ ID NO: 108497 - DNA, 235 bp, Homo sapiens
  Payload ID: 1319
  Gene Symbol: ACAP2
  Gene Name: ArfGAP with coiled-coil, ankyrin repeat and PH domains 2
  ENST ID: ENST00000439666
  CDS Start-End: 83-235
gaggcaggatgaagatgactgtggatttcgaggagtgtctgaaggactcgccccgcttcagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacaca

SEQ ID NO: 108498 - DNA, 684 bp, Homo sapiens
  Payload ID: 1319
  Gene Symbol: ACAP2
  Gene Name: ArfGAP with coiled-coil, ankyrin repeat and PH domains 2
  ENST ID: ENST00000450200
  CDS Start-End: 1-684
gagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtgattgctgtaaatagcgacgaggccaggcgggagtctctgttttgtcctgatgagctagattcactcttctcctactttgatacttcttcaaaactgcgtagtatcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggc

SEQ ID NO: 108499 - DNA, 766 bp, Homo sapiens
  Payload ID: 1319
  Gene Symbol: ACAP2
  Gene Name: ArfGAP with coiled-coil, ankyrin repeat and PH domains 2
  ENST ID: ENST00000439758
  CDS Start-End: 1-766
cagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggctgcgttacaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatcc

SEQ ID NO: 108500 - DNA, 3207 bp, Homo sapiens
  Payload ID: 1319
  Gene Symbol: ACAP2
  Gene Name: ArfGAP with coiled-coil, ankyrin repeat and PH domains 2
  ENST ID: ENST00000618471
  CDS Start-End: 61-2394
gcgcggccgctcccgcggccccctcggctttgccagcgccgcctgcgaggcggaggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttccaaactcagagatcaattataaaagtttcactaagtttttctttagagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagcatttctaaatttgggccaggggaccaagtcagagcatctgcccaaagttcagtcagaagtaatgacagtggaattcagcagagctctgatgatggaagagaatctttaccctccacggtgtcagccaatagtttatatgagcctgaaggagaaaggcaagattcttctatgtttcttgactcgaaacatcttaatccaggacttcagctttatagggcgtcatatgaaaaaaaccttcctaaaatggctgaggctttggctcatggtgcagacgtgaactgggccaattcagaggaaaacaaagcgacaccacttattcaggctgtattagggggctctttggtgacgtgtgagttcctcctacagaatggtgctaatgtcaaccaaagagatgtccaagggcggggaccattgcaccatgccaccgtcttagggcacacagggcaggtatgtttattcctaaaacgaggtgccaatcaacatgccactgatgaagaagggaaagaccctttgagcatagctgtggaagcagccaatgctgatatagtcaccttgttacgtttagcaagaatgaatgaagagatgcgggaatcagaaggactttatggacagccaggtgatgaaacttatcaggacatatttcgtgatttttcccaaatggcatccaataatccagagaaactaaatcgtttccagcaagattcacagaaattctgaatttttttaaaaatgggaaaatatgaaatctggtgaccccctaatgtatacagctaaaaaatcacaatttttttactgctttaattctacttaattttggtagatattgaatggcttggaaaagaggtacccattcatatatttataaattaaaacatagttatctagtagtaggagaggaacctagtttaggacctcttttattaaaaaagcctatttaaagggctatttctgtagacagaagttcagtctagatttaggccatctctaggttacaagatgataggaggttagacaaaagtgattcttttgccaatgggtggtggcattgatttttttcctccatgcatcttgcccaggatcactcagtcaagcatgtcttcatcaagtggaagccaactgtcctgcctgcctcaagaatatgtgttttctttagcttccctgaggctttttggtggttcagaaataggtgtgtgtgttgatgtgtttttggtaacctagctttcatacacataatatatgatttattagaactagagaatgtgttttccccgtttgttcataaatgcggtcggttatacttcttaggtgacaggttattgtccagtactttaatgtatgtatgtataatggctgtacaggtagaccataattcagtcctttagatttattttatgcagcaaaaagaagctcttttttttttttaatcacaaaaaaaaaccccagttcaaaatgtgtagttcttcattgttgggttgattccccaaaaccttgacagatgtatcgatggaataaaagtatgttttaaaggtt

SEQ ID NO: 108501 - DNA, 1647 bp, Homo sapiens
  Payload ID: 1319
  Gene Symbol: ACAP2
  Gene Name: ArfGAP with coiled-coil, ankyrin repeat and PH domains 2
  ENST ID: ENST00000635383
  CDS Start-End: 7-1647
ggcaggatgaagatgactgtggatttcgaggagtgtctgaaggactcgccccgcttcagggcagctttggaagaagtagaaggtgatgtggcagaattggaactaaaacttgataagcttgtgaaactttgtattgcaatgattgatactggaaaagccttttgtgttgcaaataaacagttcatgaatgggattcgagacctggctcagtattctagtaatgatgctgtcgttgagacaagtttgaccaagttttctgacagtcttcaagaaatgataaattttcacacaatcctgtttgaccaaactcagagatcaattaaggcacagcttcagaactttgttaaagaagatcttagaaaattcaaagatgccaagaagcaattcgaaaaagtcagtgaagaaaaagaaaatgcgttagtaaaaaatgcccaagtacaaagaaacaaacaacatgaagttgaagaagccaccaacattctgacagcaacaagaaaatgtttccgacacatagccctcgattatgtgcttcagattaatgttcttcaatcaaaaaggagatcagaaatcctaaaatcaatgttgtcatttatgtatgcccatttggccttctttcatcaaggatatgatctgtttagtgaacttggaccctacatgaaggatcttggtgcacagttggatcgactggttgtggatgcagcaaaggagaaaagagaaatggagcaaaaacattccaccattcaacaaaaggatttctccagtgatgattctaagttagaatataacgtagatgctgcaaatggcatagttatggaaggatatctgttcaaacgagccagcaatgccttcaaaacttggaacaggaaaaagcccgatcacatcaggcgctggttttcaatacagaataatcagttggtttaccagaaaaaatttaaggataatccgactgtggtagttgaagacctcaggctttgcacagtgaaacattgtgaagacatagagcgacgattctgctttgaggtggtctcgccaacaaaaagttgcatgctccaggcagattccgaaaagctgcgccaggcatggattaaggctgttcagaccagtattgctactgcttatagagagaagggtgatgaatcagagaagctggataagaaatcatctccatccacaggaagcctagattctggaaatgagtccaaagagaaattattgaaaggagaaagtgcgcttcagcgggtccagtgtatccctggcaatgccagctgttgtgactgtggcctggcagatccacggtgggccagcatcaacctgggcatcaccttgtgtatcgagtgctccggaattcaccggagccttggggttcatttttcaaaagtacgatctttaactttagacacctgggagccagaacttttaaagcttatgtgtgagttggggaatgatgttataaatcgagtttatgaagctaatgtggaaaaaatgggaataaagaaaccccaaccaggacaaagacaggagaaggaggcatatatcagagcaaaatatgtggagaggaaatttgtggataaatattctatatcattatcacctcctgagcagcaaaaaaagtttgtctctaaaagttctgaagaaaagaggctgagc

SEQ ID NO: 108502 - DNA, 2280 bp, Homo sapiens
  Payload ID: 1320
  Gene Symbol: ACAP3
  Gene Name: ArfGAP with coiled-coil, ankyrin repeat and PH domains 3
  Uniprot ID: Q96P50
  ENST ID: ENST00000353662
  CDS Start-End: 1-2280
atggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctag

SEQ ID NO: 108503 - DNA, 3896 bp, Homo sapiens
  Payload ID: 1320
  Gene Symbol: ACAP3
  Gene Name: ArfGAP with coiled-coil, ankyrin repeat and PH domains 3
  Uniprot ID: Q96P50
  ENST ID: ENST00000354700
  CDS Start-End: 204-2708
agtgacagcgggcggtgcgcgcgggcggctgactttggcgacgctccccggcggtgacaggcggggcggggcgcggcgcggcggcctcattccggggcgggcgggcgccgaggcggcgcgggcgggacgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgcccactgcctgctcctggg

SEQ ID NO: 108504 - DNA, 582 bp, Homo sapiens
  Payload ID: 1320
  Gene Symbol: ACAP3
  Gene Name: ArfGAP with coiled-coil, ankyrin repeat and PH domains 3
  ENST ID: ENST00000354980
  CDS Start-End: 7-165
gcagccatgaccgtggagttcgaggagtgcgtcaaggactccccgcgcttcagagcagcgcgtggggaacaggcagctggagccgcgtttaaggcctgggggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatg

SEQ ID NO: 108505 - DNA, 2363 bp, Homo sapiens
  Payload ID: 1321
  Gene Symbol: ADAP1
  Gene Name: ArfGAP with dual PH domains 1
  Uniprot ID: O75689
  ENST ID: ENST00000265846
  CDS Start-End: 221-1345
ccgggccccgcgccggcactcgctcagcgaccgcggcggagacacgagcggcggcggcggagcccagagggcggcgggaatgcggaaccggcgcgcgggctgaggccgcccgggatggcgcaggggcggcggcggcgggcggcctgcgcggggccctagcgagccgggctgacgctcccggccccggccccggcatcggcatcgcgggcgcatcgcggccatggccaaggagcggcgcagggcggtcctggagctgctgcagcggccggggaacgcgcgctgcgcggactgcggcgccccggatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggtt

SEQ ID NO: 108506 - DNA, 576 bp, Homo sapiens
  Payload ID: 1321
  Gene Symbol: ADAP1
  Gene Name: ArfGAP with dual PH domains 1
  ENST ID: ENST00000454383
  CDS Start-End: 1-576
gtgccgggtccaacctctctgtgagcagctccagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaa

SEQ ID NO: 108507 - DNA, 559 bp, Homo sapiens
  Payload ID: 1321
  Gene Symbol: ADAP1
  Gene Name: ArfGAP with dual PH domains 1
  ENST ID: ENST00000435943
  CDS Start-End: 72-559
tgttccagtttgttttcagccgggtgtactgcattaaccctgcaagaagaaaatggaaagaatttgaaaagatgctggggtgtgcagaggaagggcacgcgagtctgggaagagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaa

SEQ ID NO: 108508 - DNA, 622 bp, Homo sapiens
  Payload ID: 1321
  Gene Symbol: ADAP1
  Gene Name: ArfGAP with dual PH domains 1
  ENST ID: ENST00000437486
  CDS Start-End: 1-622
gtaattccctgggagtggaaaaggctggggcggctgcctgtgcacctgggccgtgccgggcctgtgtgtgggtcgtggtttctgcaatggtattggcttcactcgagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctg

SEQ ID NO: 108509 - DNA, 2093 bp, Homo sapiens
  Payload ID: 1321
  Gene Symbol: ADAP1
  Gene Name: ArfGAP with dual PH domains 1
  Uniprot ID: O75689
  ENST ID: ENST00000449296
  CDS Start-End: 165-1073
tttccttctccctcagcctgtttcgtaaacatgttctgggtccctgcagtgtgtccctgcagagtcccctcagagactctgtcctagccacatctgggtctctcgctcaccagcccatctccaggcccccgtgtctggcgcctgttggctctttgctaaatttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggttcc

SEQ ID NO: 108510 - DNA, 742 bp, Homo sapiens
  Payload ID: 1321
  Gene Symbol: ADAP1
  Gene Name: ArfGAP with dual PH domains 1
  ENST ID: ENST00000453175
  CDS Start-End: 1-738
tatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaagacttgcttgagctacaaaataaggatcttcataaaaatagcaccatctgaaaggaaggcaagttggcccaggccccagcagcaccagggccacagagagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgag

SEQ ID NO: 108511 - DNA, 2085 bp, Homo sapiens
  Payload ID: 1321
  Gene Symbol: ADAP1
  Gene Name: ArfGAP with dual PH domains 1
  ENST ID: ENST00000446141
  CDS Start-End: 1-1073
tttccttctccctcagcctgtttcgtaaacatgttctgggtccctgcagtgtgtccctgcagagtcccctcagagactctgtcctagccacatctgggtctctcgctcaccagcccatctccaggcccccgtgtctggcgcctgttggctctttgctaaatttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggc

SEQ ID NO: 108512 - DNA, 560 bp, Homo sapiens
  Payload ID: 1321
  Gene Symbol: ADAP1
  Gene Name: ArfGAP with dual PH domains 1
  ENST ID: ENST00000453823
  CDS Start-End: 1-560
ctggctgcggcctcaggcgagtggtgttcaggagcttgaagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagat

SEQ ID NO: 108513 - DNA, 2178 bp, Homo sapiens
  Payload ID: 1321
  Gene Symbol: ADAP1
  Gene Name: ArfGAP with dual PH domains 1
  Uniprot ID: O75689
  ENST ID: ENST00000539900
  CDS Start-End: 1-1158
atgttccagtttgttttcagccgggtgtactgcattaaccctgcaagaagaaaatggaaagaatttgaaaagatgctggggtgtgcagaggaagggcacgcgagtctgggaagagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggttcc

SEQ ID NO: 108514 - DNA, 1946 bp, Homo sapiens
  Payload ID: 1321
  Gene Symbol: ADAP1
  Gene Name: ArfGAP with dual PH domains 1
  ENST ID: ENST00000617043
  CDS Start-End: 87-926
gtaattccctgggagtggaaaaggctggggcggctgcctgtgcacctgggccgtgccgggcctgtgtgtgggtcgtggtttctgcaatggtattggcttcactcgagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggttcc

SEQ ID NO: 108515 - DNA, 2118 bp, Homo sapiens
  Payload ID: 1321
  Gene Symbol: ADAP1
  Gene Name: ArfGAP with dual PH domains 1
  Uniprot ID: O75689
  ENST ID: ENST00000611167
  CDS Start-End: 190-1098
agaccagctccggaaatggtgagcggctgagtcacctcgggcgtcctgggagcagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgagcttcagcttccaggatgcttctctggaacctcaaggcaggcagcccaggccctgggcctgatctctaaccccgtcatgctgctgctgaccacacccagccaacctgcccctccctgacccggggccccctttcctccagggcccagtctggctcccgagctcagacacagcccccaggagccgcccaccacggctgtgggaacttccaggcctcagcgcagagccctgcttggggccagcacggtgggcagctgccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctcgccgacagtggtgtctgaacccttggggacgagggcctgggccgcggtgaggccaccagaggcaggagtggccctgggggtcccgggcactgtcgcgcttgctgcaggcggcccagccgtgtatttatttttcacctatctccttcctgtcaaggcaggccgggctccagggctccccttgcgtggggcatgtaggtgggggaggcgtctgcaggtcacctggggggcccagccctctcccagccttgcctggctgagctgtgttccaggggagccctggacaagccctcataggcagggagggggtttccgaggccaggcatccgccgccccgtgtcgcatcctggaataaaatgtggctctggcatggttcc

SEQ ID NO: 108516 - DNA, 2934 bp, Homo sapiens
  Payload ID: 1322
  Gene Symbol: ADAP2
  Gene Name: ArfGAP with dual PH domains 2
  Uniprot ID: Q9NPF8
  ENST ID: ENST00000330889
  CDS Start-End: 336-1481
tatgcccttgttcctctttcatagacgcggaaactgagacccacagaggttgaataggttgtccacagtctcgtagctaccaagtgacaggccacgatttgatctcaggccagtgtgttaaactccaatttgcgtgctcctgtccctccccgcgcgtcggcggagctcggggccggactggacctgccgagggaggggcggacagtcctgacggtgcggggcggggctggcggctgcccaggcctggctgaggcgccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggagtttatgatccacaatggaaacctccgtgtgaaggccaagttcgaagccagagtcccagctttctactacatcccccaggccaacgactgcctggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgcagtacctaaaaatggcctttcctgaactcccagagtctgagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagtagtcaatggccgggcgcagtgagattgcgccattgcattccagcctgggtgacagagcgagactccgtatcagaaagaaaaagaggaactgaatgaaatctcagatggctgaaatgttagagaaacagagcaccaagtcccctgctctgtgactcgttgttcctttcctctgtcttcaagcaccacgcagaaatacactggatgttctctctttgcttcaatggagacccaaggagctgggaggtctcttaagagactctctgattctccgtggctgggtgtgatggctcatgcccataatcccagccctttgggaagctgaggcaggaggattgagaccaggagttcgagaagagcctgggcaacatagtgagaccccatctctacaaagaaaaaaaaattagctggacatggtaatgaatgcctgtagtcccagctactccggacactgatgtgagaggatcacttgagccagggaggtcatggctacagtgacccctcattgcaccactttacttagcctgggtgacagagtgagaccctatctcaaaaaaaaaaaaaatctatgcattgtatgggactttcctttggatcccccaatcaaaggataagcaatgcgtaagcctgtgtccttcctgaagcttctcgactgcccagatagggaggtgagtcctctctatctcctctggctctggaagcaccttgaaaatgtgcattttcaaggacacttgctgggttgtgcattaagggccagtttacttgtctgcctctttgaccacctgtgaactctgttgggtgtactctgctaagttctggggatgaggaaattaataaaggtacagtcttgccttcaaggaacttatggtctagaggagaagaacgagaagtatagataggcagtaacaaagctacttgaagaggccaactgggattctaagggtgggaaagaacagacacaagagataaagtcctaatgaaatgga

SEQ ID NO: 108517 - DNA, 296 bp, Homo sapiens
  Payload ID: 1322
  Gene Symbol: ADAP2
  Gene Name: ArfGAP with dual PH domains 2
  ENST ID: ENST00000584989
  CDS Start-End: 1-296
gaaagtgggaaggagatagtggactggttcaatgccctccgtgcagcccgtctgcagtacctaaaaatggcctttcctgaactcccagagtctgagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcacccc

SEQ ID NO: 108518 - DNA, 676 bp, Homo sapiens
  Payload ID: 1322
  Gene Symbol: ADAP2
  Gene Name: ArfGAP with dual PH domains 2
  ENST ID: ENST00000580526
  CDS Start-End: 68-322
cctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggagggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgca

SEQ ID NO: 108519 - DNA, 907 bp, Homo sapiens
  Payload ID: 1322
  Gene Symbol: ADAP2
  Gene Name: ArfGAP with dual PH domains 2
  ENST ID: ENST00000584828
  CDS Start-End: 1-437
tgtttgtgtatcatgaaagtgggaaggagatagtggactggttcaatgccctccgtgcagcccgtctgcagtacctaaaaatggcctttcctgaactcccagagtctgagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagt

SEQ ID NO: 108520 - DNA, 2271 bp, Homo sapiens
  Payload ID: 1322
  Gene Symbol: ADAP2
  Gene Name: ArfGAP with dual PH domains 2
  ENST ID: ENST00000585130
  CDS Start-End: 336-656
tatgcccttgttcctctttcatagacgcggaaactgagacccacagaggttgaataggttgtccacagtctcgtagctaccaagtgacaggccacgatttgatctcaggccagtgtgttaaactccaatttgcgtgctcctgtccctccccgcgcgtcggcggagctcggggccggactggacctgccgagggaggggcggacagtcctgacggtgcggggcggggctggcggctgcccaggcctggctgaggcgccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggagtttatgatccacaatggaaacctccgtgtgaaggccaagttcgaagccagagtcccagctttctactacatcccccaggccaacgactgcctgtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgcagtacctaaaaatggcctttcctgaactcccagagtctgagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagtagtcaatggccgggcgcagtgagattgcgccattgcattccagcctgggtgacagagcgagactccgtatcagaaagaaaaagaggaactgaatgaaatctcagatggctgaaatgttagagaaacagagcaccaagtcccctgctctgtgactcgttgttcctttcctctgtcttcaagcaccacgcagaaatacactggatgttctctctttgcttcaatggagacccaaggagctgggaggtctcttaagagactctctgattctccgtggctgggtgtgatggctcatgcccataatcccagccctttgggaagctgaggcaggaggattgagaccaggagttcgagaagagcctgggcaacatagtgagaccccatctctacaaagaaaaaaaaa

SEQ ID NO: 108521 - DNA, 1598 bp, Homo sapiens
  Payload ID: 1322
  Gene Symbol: ADAP2
  Gene Name: ArfGAP with dual PH domains 2
  ENST ID: ENST00000580525
  CDS Start-End: 84-1247
gcgccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggaggttgctgttgtcttgcagtttatgatccacaatggaaacctccgtgtgaaggccaagttcgaagccagagtcccagctttctactacatcccccaggccaacgactgcctggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgcagtacctaaaaatggcctttcctgaactcccagagtctgagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaa

SEQ ID NO: 108522 - DNA, 1080 bp, Homo sapiens
  Payload ID: 1322
  Gene Symbol: ADAP2
  Gene Name: ArfGAP with dual PH domains 2
  ENST ID: ENST00000581285
  CDS Start-End: 81-1080
ccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggagtttatgatccacaatggaaacctccgtgtgaaggccaagttcgaagccagagtcccagctttctactacatcccccaggccaacgactgcctggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtcca

SEQ ID NO: 108523 - DNA, 584 bp, Homo sapiens
  Payload ID: 1322
  Gene Symbol: ADAP2
  Gene Name: ArfGAP with dual PH domains 2
  ENST ID: ENST00000581548
  CDS Start-End: 242-584
ccaggcctggctgaggcgccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgcagtacctaa

SEQ ID NO: 108524 - DNA, 8668 bp, Homo sapiens
  Payload ID: 1323
  Gene Symbol: AGFG1
  Gene Name: ArfGAP with FG repeats 1
  Uniprot ID: P52594
  ENST ID: ENST00000310078
  CDS Start-End: 261-1949
aggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaacatgtttatttatttaagtataacagtaataaactaataacttgctaacataaataccatttttgataaaaataacttttccaaaacaaaaactaatgagaacaggaacattgttttacattttatgcatttaaatctggcttaataaaagcagtgagattttcatgctgcttttgcattccaacttaaaaattacacagcatacacacgctggaaaactccactgtgcacttgtgagatcaggagaatgaaaactatgtaatatctcagtagtacaatgaaaatagtttgacttttcacagcctttcaaagaaagggttgtagggaccattaagggtctccagactctttgagaaccactatactttaaatttgtgtatttctagaacagtatttacttgcagggcaaacataactattccctgggttttttttgtttgctagtgagaactgaaattgcagactttttaacactacttcaaggtaataatagcagtggtattatgggctgtgtatgagatagtcatttgtaaaacaattttcatatttcatctcttacaatccctgcagtggacctatacttttaggatgaaagaagcaaagcatagagaggttaagctagtggcagctttttgctctggggaacagatttggattaaatgctatcacatttatatatgaatgcattctttcttaatattttgaaattctgaacaagttaacgttcttgtcttgtatatctaaaaaaactttaatcacttgaattcctttcataatttgatgaaatcagtacagtttattcttggtttttttttttaactttagaagtaaattaatatggtaactagtggagcgtgctttagattgaagactcatctgaagtatcacagactcctattttgtaaagcattccacctttattgatacagtttgtggcctatacacttttaaaatttattttttaaaaggtgatattaaaatttgtatttaacctgttgtattcatcctcattagttaagtttttctttttatgttttaaaacttagtgacattaaacttttcacgtggttgtttgtgaacagatgaatatataaccacgatgtaatccagtgttgtgctgctgaatgtttaacaaccatctttcatgaaagaaaaaaggccctgttttgtagcatttactaatatttatggtataaatactgtcttcatggtgattttacctgccaatctgatgtcattaaatgcagtttgatgaaagagatagccaaccagtggctttcccaagccttggcaaaccagcttcagcacagcaaaggacatacaattccacaactcattaattaaatgtattggtcatttgatgattatatccagtatttggagagcttttatattgttaattcatttagcaagcatttgaacacttgtttatttttagagatatactgggcactgaggtatttaatctgcaaagacccaagtatcgtgaaccttggttttaaaaagtccaattattgtgctcttataggggttgcacattcaaggcttacactgaattctgtctgcagttctgttttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggttttttgtatgctataatatatgcttatgatttctaaaaattatgcagtatacacaaagggcataaagtcaaaaagtgtgtctccctctgtgactttattctcataccccagaggcatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtgta

SEQ ID NO: 108525 - DNA, 1669 bp, Homo sapiens
  Payload ID: 1323
  Gene Symbol: AGFG1
  Gene Name: ArfGAP with FG repeats 1
  Uniprot ID: P52594
  ENST ID: ENST00000373671
  CDS Start-End: 51-1619
gcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacat

SEQ ID NO: 108526 - DNA, 2912 bp, Homo sapiens
  Payload ID: 1323
  Gene Symbol: AGFG1
  Gene Name: ArfGAP with FG repeats 1
  ENST ID: ENST00000409315
  CDS Start-End: 54-1679
gcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtat

SEQ ID NO: 108527 - DNA, 1783 bp, Homo sapiens
  Payload ID: 1323
  Gene Symbol: AGFG1
  Gene Name: ArfGAP with FG repeats 1
  Uniprot ID: P52594
  ENST ID: ENST00000409171
  CDS Start-End: 51-1733
gcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacat

SEQ ID NO: 108528 - DNA, 2089 bp, Homo sapiens
  Payload ID: 1323
  Gene Symbol: AGFG1
  Gene Name: ArfGAP with FG repeats 1
  Uniprot ID: P52594
  ENST ID: ENST00000409979
  CDS Start-End: 271-2025
ttttcccctcaggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacagcatttagaatgctttcatctagctgcagttttggtgaatttacttcagcttttcctcttcaggctacccacagtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttg

SEQ ID NO: 108529 - DNA, 815 bp, Homo sapiens
  Payload ID: 1323
  Gene Symbol: AGFG1
  Gene Name: ArfGAP with FG repeats 1
  ENST ID: ENST00000458212
  CDS Start-End: 1-398
ctacaaacccatttcagaccaatgccagaggagcaacaggcctttctggagcaatgcattctcaagtgtttcctcacgctcattttgcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatg

SEQ ID NO: 108530 - DNA, 1065 bp, Homo sapiens
  Payload ID: 1323
  Gene Symbol: AGFG1
  Gene Name: ArfGAP with FG repeats 1
  ENST ID: ENST00000456594
  CDS Start-End: 353-1065
gagtcctagattgaactaaataatggatgagtgtatttgttttaagaggtggctggtattgatgatatccttaaaccatagataatccacaaacaattcttacttcatatcaagacaaaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaac

SEQ ID NO: 108531 - DNA, 4796 bp, Homo sapiens
  Payload ID: 1324
  Gene Symbol: AGFG2
  Gene Name: ArfGAP with FG repeats 2
  Uniprot ID: O95081
  ENST ID: ENST00000300176
  CDS Start-End: 123-1568
ggatgccgcccgctcccgagcttctgtcaggggagccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggtatgtccccccagaccaagtcaaggggcccacttataccaaaggcagtgcctccacccctgtgcagggctccatcccagaagggaagccccttcggacacttctgggtgatcctgcaccgtctctctcagttgctgcctccacctcgagccagcccgtcagtcagtctcacgctcggacatcccaggcccggagcactcagccacctccccactcctctgtcaaaaaagccagtactgacctgctggctgacatcggtggagacccctttgctgcaccccagatggcaccagcttttgctgcattccctgcctttgggggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggttgagggggagggatttttttcaaatgatcagtcccctgtggaacagctcttccctgggcctagctcgccagcgctgtgctcctcatggacgggagcgcagtggggaaggtaggggaaagatgaggcacagtgttgatggggcagtgaccagacagtcctgagacccagaaggcccaggtggcccaagtgctcttggtggcccagcttggccagcacacactttcctcctgcagcaccccctgctgaaggggtcccccattgttttgcttccccagcgcccaggatgagcggtttaccatcgagcttacccgggcccggctcctgtcaagcactttagttagctgttggtgtcatgtttggataccagtgttttatatttatacatagagaggattttctaatatagcctattatatataaatagatctatctatatgcacatacatacatatatacacacacccagccgatctcccgctcccagactgctctcgtatgtggggaatgggatgaatccccatctgtgcctcgaccatcaaagccggagctccagggctggagggggggcagccatgtgtcctgacccccaccatccccagagcctgggttttccagggaaaggctttgtgcaattgcctggtctttttttttttttttttttctccatgtgcctccctgtccccaaatctctgcaccaaagctcattgcaggcaatgttggaaaagaactgcatttgaacgaaagagaaaacggcgcctgtggttttgcttcaggccactttgaggggttgcaggtcagtcaacatgactgatccttgacctggctctgctgggctggactgcctgggccagtgataatgctgccattggccagagacagggcagagcccgtccctgtctgaacaagagtcccgcattagcaatgagaagaagcgtggcgggagaggagccaccactgccggggactggagtttgttggatgtgaggggaatgcccactggggccagggtgggcaaaggaggttggtgccaatgtggtgctggaagtagacccctcctgggtctggaacattctctgccccaggctctttccacctggggatgttgtgacaacatccagctgtggtgtctgggctatttgtgtggtgacaagacagacctggtcagggggtgggtggcaaacacctcacctggctgggcagaggccaccttgctgtttggcccaaggccaggtgaggcccctccctttccaccattgccctggccccgtggccattcattcttggggtttgtctgagtcttccacagagagcagcaaagagatatgggagttgggtgatcagtgtatttactttgcagatttttctggaaataacctctagctgctgctatttgcaaggctgggattggcctccctgtcttttccaacaatcaggaccccatcctgtctgttcctgttcttctcccagcctctgccctccttctgtctcctgggtggtctcccgcttcgctcctggcctttgcatgttccatctcttctctttctcccctcttcgccaccctagattatctctgtgtccctctacctaattctcttaccagttctttcctttctgcttagagccggagggagggaagctggaatctgttatggtgtattagggggaggagcctttctgttatttccccccagcttccatcacccttcccttaatgccaggagcgccgaggtttggaactgaggctaaaccgaagggctttctcctgcttctgtcaccctgtgctgtctcccggcatctcctcactatctgggtccaggcccgggtcctccctgcagactccctcccctccagcccacaaggactccagcctgctggctggtgagagctggatgagcagtaagaagttaacgccaggtcagcctcgggccccagggttccctgggcacaggctgacactaggagctgctctccttggccggggacagctccagcagctcaggctccagccctccagtgagccgcctctcctggagagtagcaaagaatggagaaaggcctggcttgagaggaaatggagaaaacattgcctggtagctgcagattcaaacccaccacacacaccacggggctagagtgactcacctgggctcacaccaacttctggccaatgcagggaccatgctctgcagacagcagtcctctagcatggccccagcattcagccagtcggtcacctgtgggccatccccatgtgtgaggaagcaggagtcagccaccaagtgtctccacatcggagcttgcgggtcagacctgtgggccaggggatgggagcagggctgagggtaggggctgaatgtgtggctctgtccctgtgttgccttccacagaggagcaaggcctcaggctgaggaaggaggggcacgctggaacagcctagtctcctccccgtggattcccccaaacccataacattcttccataggggctgagaacgcagtgccccgtccctgacagggatgaaaagtgaacccctcaggtcaggagaggcagagttgaggttctgccacttcctgtccctggggagccactcaagttaccagggctaccggctgaaataaatcttttccgggtagggtcaagggcagtgtgttgccaaggcaactgatgtaggccagttgcgtgactccaggtttgtcctggtactcagtgggtccaatcacctggcattgatcacctggcattgatcagcacccaccccacccctgaggcttgcccagcccccaggccctcagatccctgctcttcctgcctttcctgcccatgtgtcacccagcacccaaggttcagtgacacagggtggtttggagctggtcactgtcatagcagctgtgatttcacaaggaagggtgctgcagggggacctggttgatggggagtgggaaggggaaggaataaagagatcttcctcaggt

SEQ ID NO: 108532 - DNA, 928 bp, Homo sapiens
  Payload ID: 1324
  Gene Symbol: AGFG2
  Gene Name: ArfGAP with FG repeats 2
  ENST ID: ENST00000429987
  CDS Start-End: 1-671
gctcttctgtgtttggaagcctccctccagctggtcaagcctcgttccaggcccagccaactcctgcagccagtcggatgctaactgaaagttacagctttgggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaaccctttcacagctcccgccgcccagtccccgctgccttccaccaacccgttccagcccaatggcttggcgccagggcccggctttgggatgagcagtgctgggcctggcttcccccaggcagtgccacccactggggcctttgccagctccttcccagcaccgctgttccccccgcagaccccgcttgttcagcagcagaatggctcttccttcggggacttaggatcagccaagttggggcagaggccactgagccagccagctgggatctccaccaaccccttcatgactggaccctcatcaagcccattcgcctccaaacctccaaccaccaaccccttcttgtagcactgtgtttttggggggcctcttccctgccttctggggcccctctgctccctagagctctggtgaccacttgcctgtgggcatttctatgggccttggggatggtggaggtgctaatgctttgcttggggcctacaggtgaaaggtggctgccctcagattccacaaagcctctctcccctccctcgtcccacccccacccaggcaggaagcccaggaggagtgcgggcagggcctgacctggaggagtgatggtt

SEQ ID NO: 108533 - DNA, 915 bp, Homo sapiens
  Payload ID: 1324
  Gene Symbol: AGFG2
  Gene Name: ArfGAP with FG repeats 2
  ENST ID: ENST00000430857
  CDS Start-End: 137-604
gcgaagtctcctgcggatgccgcccgctcccgagcttctgtcaggggagccgggcgtgcggaggcggctgaggaggcgggaaggcggcagtggttgaaggggtgattgctgactagcggggagggagtgggcagcgatggtgatggcggcgaagaagggcccgggcccgggcggcggggtcagcgggggcaaggcggaggcggaggcggcctcggaggtgtggtgccgtcgggtgcgggagctgggtggctgcagccaggccgggaaccgccactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtttgatgctcggacatctttagtaccagattccagggatcctcagaaagtgaaggagtttctccaggaaaaatatgagaagaagagatggccagacaccttcccaaggaggctttgccaactttgatgcctttagcagtggccccagctcttctgtgtttggaagcctccctccagctggtcaagcctcgttccaggcccagccaactcctgcagggagcagccaggggactccatttggtgccactcccctggcacccgccagtcagccaaacagcctcgcagacgtgggcagcttcctgggacccggggtgcccgctgcaggtgttcctagcagcctcttcgggatggctggccaggtccccccgctccagtctgtcacgatgggcggcggcggcggcagcagcacagggctggcctttggagccttcactaacc

SEQ ID NO: 108534 - DNA, 10832 bp, Homo sapiens
  Payload ID: 1325
  Gene Symbol: AGAP1
  Gene Name: ArfGAP with GTPase domain, ankyrin repeat and PH domain 1
  Uniprot ID: Q9UPQ3
  ENST ID: ENST00000304032
  CDS Start-End: 581-3154
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 108535 - DNA, 5427 bp, Homo sapiens
  Payload ID: 1325
  Gene Symbol: AGAP1
  Gene Name: ArfGAP with GTPase domain, ankyrin repeat and PH domain 1
  Uniprot ID: Q9UPQ3
  ENST ID: ENST00000336665
  CDS Start-End: 581-2995
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 108536 - DNA, 563 bp, Homo sapiens
  Payload ID: 1325
  Gene Symbol: AGAP1
  Gene Name: ArfGAP with GTPase domain, ankyrin repeat and PH domain 1
  ENST ID: ENST00000402604
  CDS Start-End: 213-563
atccggtttggcaggaacaggacagggtggttagcaggccacagtgtggtgggagtgaaagtgtactgtcctgtgtgatatttttgcacagcctgacagtgggggcaagtttagagcctttgagctgagaatctggagagagcagtggatgcgatgggcagttgcttgtccttgctgtgagaagacaggccacggggctgcacccagcccccatggatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgag

SEQ ID NO: 108537 - DNA, 6138 bp, Homo sapiens
  Payload ID: 1325
  Gene Symbol: AGAP1
  Gene Name: ArfGAP with GTPase domain, ankyrin repeat and PH domain 1
  ENST ID: ENST00000409538
  CDS Start-End: 497-3706
gcgcgtttccattttaaaccgccgcccgccgcccgccacccgccacccttcggccgcagccggtgcagctgtccgcgcgtcccggagcccagggagtggcggaggctgcggaaccgccgagctgtgcagccggagcgggaggatgcgcacgggccccgcgtcgtagacaatgaagccgcgggcgccgccgcctgccctgggccctgcgcaccgcggccgcacctgccggcgagagcgctctagcgcctgaccggccgcctcgcttggccccgccggcccatggctcggcgccccgggcccggaccccggcactcgggcggcgcggcgcacgggccggcgggtgccaggggcgccgtccccgcagcctgagtgcggccctcgcggtcagcggggggcgtgggccacactcccggcccgcctgccctccccgcttggcccggcgccctcccggcccgcgggctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggagggtccccggccgcgcgcttgggatttccgcaccttccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacactgggcggcggaaggcgccacagcagctccgggagcctggcctgggcgccgtgcgacgaggccgcggccgggaccaccctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgggcggcggccggggccggcgcggcctcggagcaccggctgctgcgcttcttcagcggcatcttcgcgcgcagggacgggggcccgggcggcgggccctcgccacggagcggagcctcgcggccacgcggctacttcagcctgcggcgggccccggccgaagcgcactcgtccagcgccgagagcatcgacggctccccgcgcagagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 108538 - DNA, 2165 bp, Homo sapiens
  Payload ID: 1325
  Gene Symbol: AGAP1
  Gene Name: ArfGAP with GTPase domain, ankyrin repeat and PH domain 1
  Uniprot ID: Q9UPQ3
  ENST ID: ENST00000409457
  CDS Start-End: 599-1816
ggcgctcggagcgggctccgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattagcggtgggagttaacatagaggtgaactccagatcggccgatagcttgcaggccgctgctgtttgtcctgacttcagcgcatctctgatagacctttgacaccttccaacaaagaggttacaggagggagagctggagaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaaaatccaagattga

SEQ ID NO: 108539 - DNA, 826 bp, Homo sapiens
  Payload ID: 1325
  Gene Symbol: AGAP1
  Gene Name: ArfGAP with GTPase domain, ankyrin repeat and PH domain 1
  ENST ID: ENST00000418654
  CDS Start-End: 1-826
ctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagccaaacgcaaagcatggaaactaaaccgtgttggtagcctgcgaaatatatacagcagcagcaccaacactgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggcc

SEQ ID NO: 108540 - DNA, 757 bp, Homo sapiens
  Payload ID: 1325
  Gene Symbol: AGAP1
  Gene Name: ArfGAP with GTPase domain, ankyrin repeat and PH domain 1
  ENST ID: ENST00000448025
  CDS Start-End: 1-757
gaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagccaaacgcaaagcatggaaactaaaccgtgttggtagcctgcgaaatatatacagcagcagcaccaacactgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgc

SEQ ID NO: 108541 - DNA, 10090 bp, Homo sapiens
  Payload ID: 1325
  Gene Symbol: AGAP1
  Gene Name: ArfGAP with GTPase domain, ankyrin repeat and PH domain 1
  ENST ID: ENST00000428334
  CDS Start-End: 1-2412
gatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 108542 - DNA, 1057 bp, Homo sapiens
  Payload ID: 1325
  Gene Symbol: AGAP1
  Gene Name: ArfGAP with GTPase domain, ankyrin repeat and PH domain 1
  ENST ID: ENST00000619456
  CDS Start-End: 2-1057
agatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattag

SEQ ID NO: 108543 - DNA, 9932 bp, Homo sapiens
  Payload ID: 1325
  Gene Symbol: AGAP1
  Gene Name: ArfGAP with GTPase domain, ankyrin repeat and PH domain 1
  ENST ID: ENST00000614409
  CDS Start-End: 2-2254
agatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttcccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctctaggtccccgtggcgcccaggacaccaactctccctccctgcacttaggatgttctggaaatgagaggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgct

SEQ ID NO: 108544 - DNA, 2478 bp, Homo sapiens
  Payload ID: 1325
  Gene Symbol: AGAP1
  Gene Name: ArfGAP with GTPase domain, ankyrin repeat and PH domain 1
  ENST ID: ENST00000635100
  CDS Start-End: 1-327
cagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggaatatggatgcaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcac

SEQ ID NO: 108545 - DNA, 5388 bp, Homo sapiens
  Payload ID: 1326
  Gene Symbol: AGAP2
  Gene Name: ArfGAP with GTPase domain, ankyrin repeat and PH domain 2
  Uniprot ID: Q99490
  ENST ID: ENST00000257897
  CDS Start-End: 87-2597
ggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcaggtgtgtggtctgggcaaagcgacaagaggggggaggtagcaaagaagattggactagaggacctggccgttcccccttcacctccaagaccctggactctcttatttcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaa

SEQ ID NO: 108546 - DNA, 4464 bp, Homo sapiens
  Payload ID: 1326
  Gene Symbol: AGAP2
  Gene Name: ArfGAP with GTPase domain, ankyrin repeat and PH domain 2
  ENST ID: ENST00000328568
  CDS Start-End: 1-3109
cacctcctcccggcgccccctgctcagcagcccgagctggggcggcccggagcccgaaggccgggcgggcggcggcatccctggctcatcctctccgcaccctggcaccggcagccggaggctcaaggtggcgcctcctccgccggctcccaagccttgcaagaccgtgaccacgagtggagccaaagccggcgggggcaagggcgcgggtagccgcctgtcatggcccgaaagcgagggcaagcccagggtcaaggggtcaaagagcagcgccgggactggagcttcggtctctgccgccgccaccgccgccgccgccgggggagggggctctacagcttcgacctctggtggggtcggggctggggctggagcccgagggaagttgtcccctcggaaaggcaagagtaagaccttggacaacagtgacttgcatccgggaccgcctgccggctctcctcctccgctaaccctcccaccaactccgagtccagccactgctgtcaccgctgcttccgcgcagccccccgggcctgcacctccaatcactctggagcctccagctccggggctgaaacggggccgggaggggggccgagcatccactcgtgaccgcaagatgctcaagtttatcagcggcatcttcaccaagagcacaggagggcctcctggctccgggccccttcccggaccccccagcctgtcttctggcagcgggtccagggagctgctgggcgccgagctccgcgcttcccctaaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtcta

SEQ ID NO: 108547 - DNA, 608 bp, Homo sapiens
  Payload ID: 1326
  Gene Symbol: AGAP2
  Gene Name: ArfGAP with GTPase domain, ankyrin repeat and PH domain 2
  ENST ID: ENST00000549129
  CDS Start-End: 1-510
cgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacgggtcagtggggatgaccttccatctgctgtcttccacacccaaataggatgagtgtgggaaatgaatatggggtgaaggcttggaggctggaataaatgcatgagtgaacaca

SEQ ID NO: 108548 - DNA, 3579 bp, Homo sapiens
  Payload ID: 1326
  Gene Symbol: AGAP2
  Gene Name: ArfGAP with GTPase domain, ankyrin repeat and PH domain 2
  ENST ID: ENST00000547588
  CDS Start-End: 1-3579
atgagccggggcgcgggcgcgcttcagcgccggacaacgacctacctcatctcgctgaccctggttaagctcgagtcggtgcctccgccgccgccttctccgtctgcggccgcggccggcgccgccggtgccagaggctccgagactggggatcctggcagcccccgaggcgcggaggagccgggcaagaagcggcacgaacgtctcttccaccggcaggatgcgctgtggatcagcacgagcagcgcgggcaccgggggcgcggagcccccagccctgtccccggctccggccagtccggcccgcccagtctcccccgctcccggccgccgcctctccctctgggccgtccctccgggacccccgctctccgggggactgagccccgaccccaagcctgggggcgcccccacctcctcccggcgccccctgctcagcagcccgagctggggcggcccggagcccgaaggccgggcgggcggcggcatccctggctcatcctctccgcaccctggcaccggcagccggaggctcaaggtggcgcctcctccgccggctcccaagccttgcaagaccgtgaccacgagtggagccaaagccggcgggggcaagggcgcgggtagccgcctgtcatggcccgaaagcgagggcaagcccagggtcaaggggtcaaagagcagcgccgggactggagcttcggtctctgccgccgccaccgccgccgccgccgggggagggggctctacagcttcgacctctggtggggtcggggctggggctggagcccgagggaagttgtcccctcggaaaggcaagagtaagaccttggacaacagtgacttgcatccgggaccgcctgccggctctcctcctccgctaaccctcccaccaactccgagtccagccactgctgtcaccgctgcttccgcgcagccccccgggcctgcacctccaatcactctggagcctccagctccggggctgaaacggggccgggaggggggccgagcatccactcgtgaccgcaagatgctcaagtttatcagcggcatcttcaccaagagcacaggagggcctcctggctccgggccccttcccggaccccccagcctgtcttctggcagcgggtccagggagctgctgggcgccgagctccgcgcttcccctaaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagccaagcgcaaaatgtggaaactaaaatcctttggtagtttaagaaatatttataaagcagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatag

SEQ ID NO: 108549 - DNA, 2675 bp, Homo sapiens
  Payload ID: 1327
  Gene Symbol: AGAP3
  Gene Name: ArfGAP with GTPase domain, ankyrin repeat and PH domain 3
  ENST ID: ENST00000335367
  CDS Start-End: 94-1824
gccggaggtccgtgcgccccggccgcggccccggcccgggcccagccccgtgcccctcgccatgggcctggcccgcgcccgccggccctgagcatggagcggggctggccgcagggggacagctgtcccggggagcggcccgccgcttgccgccgcgcccacagcgtctgcgactcgctggacctgcacggcgcctcggccggccgcgctgccgccgccctgcaggccgccctctgcgccgccagtgagcagccggcgcggccgcggagcgtgtgctcgggcggcccggagccgccgcccaccggcgcccgcggccttttgctcggcctcctgcgcccgcgcctcggccgccggggcctggcgccctcgggaccgcccgtctcgcctgcgcccagccccgcgtccagccccgcgccgacccggcgcagccgcacccgcggggagccgactccgcggccccggccggccagcatgactttcctggaggtgaaccgcctggagctggcggccgccgaggcgccgggcgcgggtctggggcgcgcgggcagcgcgggcttcctgcgcggcgcggcgttgtggagcagccagcgctggccagtgctgcgcggcgggcgcgggccggaggggccccggcgcggcctggcggcgctcaggaagagcttcagcttccgcctgcgccgcggccaggaggtgcggcgctccgagtcagggctgctggcccggccgccgcgcgcgcgcacccgtagcgacggcgacgccggctccctaggcgccttccccagccgccgcgacctgctgggctccgacgccccgcgcgcagcgccggagcccggccgcccccgcaccgccgccggcctctggaggctgctcacgagccgcttccgccggagggagcccgcgcccgccgcgccgctgtggggccgtcgggcggctgcggccccggagctcctgcgcgcgcccagcgactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgccgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatact

SEQ ID NO: 108550 - DNA, 3225 bp, Homo sapiens
  Payload ID: 1327
  Gene Symbol: AGAP3
  Gene Name: ArfGAP with GTPase domain, ankyrin repeat and PH domain 3
  Uniprot ID: Q96P47
  ENST ID: ENST00000397238
  CDS Start-End: 1-2736
atgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcg

SEQ ID NO: 108551 - DNA, 582 bp, Homo sapiens
  Payload ID: 1327
  Gene Symbol: AGAP3
  Gene Name: ArfGAP with GTPase domain, ankyrin repeat and PH domain 3
  ENST ID: ENST00000469901
  CDS Start-End: 1-582
tcgagggtgagcggagccgggggctgcgggagccggggcgcagtggcctctccggcgccggccgagggctccacaggccgtgcctggccatgctctccctgtcgggggtccttgcgcgcttgaggaccaggccacgagactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctga

SEQ ID NO: 108552 - DNA, 1707 bp, Homo sapiens
  Payload ID: 1327
  Gene Symbol: AGAP3
  Gene Name: ArfGAP with GTPase domain, ankyrin repeat and PH domain 3
  ENST ID: ENST00000461065
  CDS Start-End: 1-1214
aggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggc

SEQ ID NO: 108553 - DNA, 2730 bp, Homo sapiens
  Payload ID: 1327
  Gene Symbol: AGAP3
  Gene Name: ArfGAP with GTPase domain, ankyrin repeat and PH domain 3
  Uniprot ID: Q96P47
  ENST ID: ENST00000463381
  CDS Start-End: 497-2239
cttttaggagagcactgctgcagccggcagtggagagcctgggcagggagacagggagaaaactccggcagcagggtggtctctagggctgacctcggagcctggggacaggggagcctatgccgcactgaaggcgggacgctactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtg

SEQ ID NO: 108554 - DNA, 1881 bp, Homo sapiens
  Payload ID: 1327
  Gene Symbol: AGAP3
  Gene Name: ArfGAP with GTPase domain, ankyrin repeat and PH domain 3
  ENST ID: ENST00000479901
  CDS Start-End: 1-1032
atgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgccgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaata

SEQ ID NO: 108555 - DNA, 540 bp, Homo sapiens
  Payload ID: 1327
  Gene Symbol: AGAP3
  Gene Name: ArfGAP with GTPase domain, ankyrin repeat and PH domain 3
  ENST ID: ENST00000468796
  CDS Start-End: 1-534
gatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagaggatatgtgccactgtttccaacttttcatcaacaaaaaggcctttccaactccttccaaattagaagacc

SEQ ID NO: 108556 - DNA, 2039 bp, Homo sapiens
  Payload ID: 1327
  Gene Symbol: AGAP3
  Gene Name: ArfGAP with GTPase domain, ankyrin repeat and PH domain 3
  Uniprot ID: Q96P47
  ENST ID: ENST00000473312
  CDS Start-End: 1-1191
atgaacttccaggcgggcggggggcagagcccgcagcagcagcagagcctggcggctccggggggcggcggcgctgccgcgcagcagctcgtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgccgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaat

SEQ ID NO: 108557 - DNA, 826 bp, Homo sapiens
  Payload ID: 1327
  Gene Symbol: AGAP3
  Gene Name: ArfGAP with GTPase domain, ankyrin repeat and PH domain 3
  ENST ID: ENST00000467724
  CDS Start-End: 1-512
ccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaa

SEQ ID NO: 108558 - DNA, 3121 bp, Homo sapiens
  Payload ID: 1327
  Gene Symbol: AGAP3
  Gene Name: ArfGAP with GTPase domain, ankyrin repeat and PH domain 3
  Uniprot ID: Q96P47
  ENST ID: ENST00000622464
  CDS Start-End: 1-2628
atgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggc

SEQ ID NO: 108559 - DNA, 2715 bp, Homo sapiens
  Payload ID: 1328
  Gene Symbol: AGAP4
  Gene Name: ArfGAP with GTPase domain, ankyrin repeat and PH domain 4
  ENST ID: ENST00000311652
  CDS Start-End: 411-2402
gggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggcccgcagccctagccggggccggggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccacctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattga

SEQ ID NO: 108560 - DNA, 2439 bp, Homo sapiens
  Payload ID: 1328
  Gene Symbol: AGAP4
  Gene Name: ArfGAP with GTPase domain, ankyrin repeat and PH domain 4
  Uniprot ID: Q96P64
  ENST ID: ENST00000448048
  CDS Start-End: 127-2118
gtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccacctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattgatttttgta

SEQ ID NO: 108561 - DNA, 413 bp, Homo sapiens
  Payload ID: 1328
  Gene Symbol: AGAP4
  Gene Name: ArfGAP with GTPase domain, ankyrin repeat and PH domain 4
  ENST ID: ENST00000492347
  CDS Start-End: 1-413
gcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaag

SEQ ID NO: 108562 - DNA, 2387 bp, Homo sapiens
  Payload ID: 1328
  Gene Symbol: AGAP4
  Gene Name: ArfGAP with GTPase domain, ankyrin repeat and PH domain 4
  ENST ID: ENST00000618171
  CDS Start-End: 113-2089
agcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccacctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggc

SEQ ID NO: 108563 - DNA, 2784 bp, Homo sapiens
  Payload ID: 1328
  Gene Symbol: AGAP4
  Gene Name: ArfGAP with GTPase domain, ankyrin repeat and PH domain 4
  ENST ID: ENST00000616763
  CDS Start-End: 411-2471
gggcattgtgtgccacatgcctgggctcccacctggggccagtgggcttcagtctgtaggtgactacagaaggaggaggagctccgtctgttctctcttcaggcagttgttgtgtctctcagcacttgttgggttcacaacctattaaataagccggctggtcttcaccctcccagacaagtcaactcaggggaggcagcagggtgcgggccttggcccgcagccctagccggggccggggccagggccagggccagggctggtgcccggggccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccacctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacaagtgtgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataaatatgcattga

SEQ ID NO: 108564 - DNA, 2394 bp, Homo sapiens
  Payload ID: 1329
  Gene Symbol: AGAP5
  Gene Name: ArfGAP with GTPase domain, ankyrin repeat and PH domain 5
  Uniprot ID: A6NIR3
  ENST ID: ENST00000374094
  CDS Start-End: 113-2173
agcgggaagaccatctctgcaagtgcagcatagcctcggcctaggacagtgggagtgtgtggccaaagctgtgagcagaggcacaggtggtggcagacagtagaggcgccccatggggaacatactgacctgttgtgtgcaccctagcgtcagcctcgagtttgaccagcaacaggggtcggtgtgtccctctgaatctgagatctatgaggcaggagctggggacaggatggcaggagcgcccatggctgctgctgtgcagcctgctgaggtgaccgttgaagttggtgaggacctccacatgcaccacattcgtgaccaggagatgcctgaagctttggagtttagcctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccagccagcattatcttacaatgacaataatatctgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtcacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgtgcacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacatggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggc

SEQ ID NO: 108565 - DNA, 2430 bp, Homo sapiens
  Payload ID: 1329
  Gene Symbol: AGAP5
  Gene Name: ArfGAP with GTPase domain, ankyrin repeat and PH domain 5
  ENST ID: ENST00000443782
  CDS Start-End: 127-2118
gtgggcaggcgaggagcgggaagaccatctctgcaagtgcagcatagcctcggcctaggacagtgggagtgtgtggccaaagctgtgagcagaggcacaggtggtggcagacagtagaggcgccccatggggaacatactgacctgttgtgtgcaccctagcgtcagcctcgagtttgaccagcaacaggggtcggtgtgtccctctgaatctgagatctatgaggcaggagctggggacaggatggcaggagcgcccatggctgctgctgtgcagcctgctgaggtgaccgttgaagttggtgaggacctccacatgcaccacattcgtgaccaggagatgcctgaagctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccagccagcattatcttacaatgacaataatatctgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtcacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgtgcacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacatggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaaagttcataaatatgcatt

SEQ ID NO: 108566 - DNA, 497 bp, Homo sapiens
  Payload ID: 1329
  Gene Symbol: AGAP5
  Gene Name: ArfGAP with GTPase domain, ankyrin repeat and PH domain 5
  ENST ID: ENST00000607663
  CDS Start-End: 1-83
aatacagctcgtgttcgacaatattccttgatgacagcacagccagccagcattatcttacaatgacaataatatcgcactgagaagccttttaggaaaatcaggatggatgtgaggcatctttctgtgaagaaaagcatcccagaagattctgattttcaccccagctcaatcattccaaactttgctgctgattgaaatcacctgggaaacgtttaccaagaaccttgatgcccaaagccatacccaatactaattaaattaaaatgtctcatgtggaagatgaggcagatattaaagcttctcaggcgattttaatgtgcagcaaagtttgagagccactgcttaatttgagtttaggacgagaaactgctcctatttggtgggaccttgggcaagtcagttttaagtgtgaccttggagatacctcatcatatcacacaaagagatgcagatagatctttgagcatacctgatgaacagttacactcatttgc

SEQ ID NO: 108567 - DNA, 2387 bp, Homo sapiens
  Payload ID: 1329
  Gene Symbol: AGAP5
  Gene Name: ArfGAP with GTPase domain, ankyrin repeat and PH domain 5
  ENST ID: ENST00000621690
  CDS Start-End: 113-2089
agcgggaagaccatctctgcaagtgcagcatagcctcggcctaggacagtgggagtgtgtggccaaagctgtgagcagaggcacaggtggtggcagacagtagaggcgccccatggggaacatactgacctgttgtgtgcaccctagcgtcagcctcgagtttgaccagcaacaggggtcggtgtgtccctctgaatctgagatctatgaggcaggagctggggacaggatggcaggagcgcccatggctgctgctgtgcagcctgctgaggtgaccgttgaagttggtgaggacctccacatgcaccacattcgtgaccaggagatgcctgaagctttggagtttagcctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccagccagcattatcttacaatgacaataatatctgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtcacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgtgcacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacatggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggc

SEQ ID NO: 108568 - DNA, 2779 bp, Homo sapiens
  Payload ID: 1329
  Gene Symbol: AGAP5
  Gene Name: ArfGAP with GTPase domain, ankyrin repeat and PH domain 5
  ENST ID: ENST00000581191
  CDS Start-End: 405-2465
gggcattctgtgccacatgcctgggctcccacctggggccagtgggcttcagtctgtaggtgactacagaaggaggaggagctccgtctgttctctcttcaggcagttgttgtgtctctcagcgcttgttgggttcacaacctattaaataagccagctggtcttcaccctcccagacaagtcaactcaggggaggcagcagggtgtgggccttgacccgcagccctagccggggccggggccggggccagggatggtgcccggggccgcgctgtgaggtgggcaggcgaggagcgggaagaccatctctgcaagtgcagcatagcctcggcctaggacagtgggagtgtgtggccaaagctgtgagcagaggcacaggtggtggcagacagtagaggcgccccatggggaacatactgacctgttgtgtgcaccctagcgtcagcctcgagtttgaccagcaacaggggtcggtgtgtccctctgaatctgagatctatgaggcaggagctggggacaggatggcaggagcgcccatggctgctgctgtgcagcctgctgaggtgaccgttgaagttggtgaggacctccacatgcaccacattcgtgaccaggagatgcctgaagctttggagtttagcctttctgccaatccagaggcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccagccagcattatcttacaatgacaataatatctgtgaccttggagatacctcatcatatcacacaaagagatgcagatagatctttgagcatacctgatgaacagttacactcatttgcggtttccaccgtgcacattacgaagaacagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtcacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgtgcacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacatggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaaagttcataaatatgcattga

SEQ ID NO: 108569 - DNA, 2703 bp, Homo sapiens
  Payload ID: 1330
  Gene Symbol: AGAP6
  Gene Name: ArfGAP with GTPase domain, ankyrin repeat and PH domain 6
  Uniprot ID: Q5VW22
  ENST ID: ENST00000374056
  CDS Start-End: 399-2390
gggcattgtgtgccacatgcctgggctcccacctggggccagtgggcttcagtctgtaggtgactacagaaggaggaggaactccgtctgttctctcttcaggcagttgttgtgtctctcagcgcttgttggtttcacaacctattaaataagccggctggtcttcaccctcccagacaagtcaactcaggggaggcagcagggtgcgggccttggcccgcagccctagccggggccggggccagggctggtgcccggggcctcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcattga

SEQ ID NO: 108570 - DNA, 2372 bp, Homo sapiens
  Payload ID: 1330
  Gene Symbol: AGAP6
  Gene Name: ArfGAP with GTPase domain, ankyrin repeat and PH domain 6
  Uniprot ID: Q5VW22
  ENST ID: ENST00000412531
  CDS Start-End: 73-2133
ctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcaca

SEQ ID NO: 108571 - DNA, 2690 bp, Homo sapiens
  Payload ID: 1330
  Gene Symbol: AGAP6
  Gene Name: ArfGAP with GTPase domain, ankyrin repeat and PH domain 6
  ENST ID: ENST00000618025
  CDS Start-End: 712-2379
ctgataggaagtgaaaggtggctgaggtaatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggagttgctccttcacatgttcccactctctgtgcggccaccatgtaagtcggacctgcccttctgccatgattgactaaaatctcaggaagctggtgatgaatgaaaaccttagtcccaatggcactgcacgaggggccaggagagcagcagcatcataagccacaggcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatggtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggccacattgcccaagtcacacaggcttctgtattatgtatttagataaaatgtgtgaaaacatatttgaaataaagttcataaatatgcatt

SEQ ID NO: 108572 - DNA, 2387 bp, Homo sapiens
  Payload ID: 1330
  Gene Symbol: AGAP6
  Gene Name: ArfGAP with GTPase domain, ankyrin repeat and PH domain 6
  ENST ID: ENST00000622418
  CDS Start-End: 113-2089
agcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagagtcaagcacaatattccagaggaactctcaaacagaagctttggagtttaacccttctgccaatccagaggcaagcacaatattccagaggaactctcaaacagatgttgtagaaataagaagaagcaactgtacaaaccatgtatctgctgtgcgtttcagtcaacaatacagcttgtgttcgacaatattccttgatgacagcacagccatccagcattatcttacaatgacaataatatctgtgaccttggagatacctcatcatatcacacaaagagatgcagatagaactttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacgcccgtttgcaagcggtccatgcgctggtccaacctgtttacatctgagaaagggagtgacccagacaaagagaggaaagccccggagaatcatgctgacaccatcgggagcggtagagccatccccattaaacagggcatgctcttaaagcgaagtgggaaatggctgaagacatggaaaaagaaatacgtcaccctgtgttccaatggcatgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcccccacctttcccgtgtgcgatctctggagctggatgactggccagttgagctcaggaaggttatgtcatctattgtcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcctgtgaggaggtgaacgagacctgtggggagggagacggctgcacggcgctccatctggcctgccgcaaggggaatgtggtcctggcgcagctcctgacggggtggacgtcatggcccgagatgcccacgggaacacagcgctgacctacgcccggcaggcctccagccaggagtgcatcaacgtgcttctgcagtacggctgccccgacgagtgtgtgtagtatctgttttatttgactgcagtctccttggtgcaaaaacaaaatgggaaaaataaggataactcagaatttcaaaaggaaatcacaaattcagctaatattagcattttcagtacttttcgtaaactaagtaaatacacaaaatgttgatttttctgaccataagacgtattttatgtccttctgccaaggtggatttgttagtctcaggccctcctggc

SEQ ID NO: 108573 - DNA, 2387 bp, Homo sapiens
  Payload ID: 1331
  Gene Symbol: AGAP9
  Gene Name: ArfGAP with GTPase domain, ankyrin repeat and PH domain 9
  Uniprot ID: Q5VTM2
  ENST ID: ENST00000452145
  CDS Start-End: 113-2089
agcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaactcttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcgtaaactaagtaaatacacaaaatgttgatttttctgaccataagacatattttatgtccttttgccaaggtggatgtgttagtctcaggccctcctggc

SEQ ID NO: 108574 - DNA, 4942 bp, Homo sapiens
  Payload ID: 1332
  Gene Symbol: ARAP1
  Gene Name: ArfGAP with RhoGAP domain, ankyrin repeat and PH domain 1
  Uniprot ID: Q96P48
  ENST ID: ENST00000334211
  CDS Start-End: 736-4353
acttttcgctttctcagtgttttcaggaagtgtgtgtgttggccacggctgcaggaggtgggggagacacaaagcaggaagcctccgggagaccagagctgggtgcagacatacacacacacatacacacagacacacagagtcacacacactcacacacactctctctctctctccctctgtctttctctctctctctctctctctgtcctttcctcctggacagatccacagttatacacagaaacaaacacacacgcacgtagagaagtgattcacaaacacttaaagacataaatcacaggtgcaaagccatacctgggctcaaaaacctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 108575 - DNA, 5767 bp, Homo sapiens
  Payload ID: 1332
  Gene Symbol: ARAP1
  Gene Name: ArfGAP with RhoGAP domain, ankyrin repeat and PH domain 1
  Uniprot ID: Q96P48
  ENST ID: ENST00000359373
  CDS Start-End: 853-5172
gattcacaaggaatgaccctcttcatcgcctctcctaattcagtcctcacaacagtccttttacaaatgggacaacaggttagaggaagtcaggcagatttccagcatcatagagagtaaaggaccagggaaggatcaggattcaaggactgcacccaggctctgcttccagcttgctgtgtgactttgggtaattttgttcccttagggaactgagctttctcatttgtaaatgcaaacaggctgttgggaggatcaaatgagatccaggggtgaaaacagcttagtttactttcaggaatttacccacgcggtatataaaggcaaaatattattatagtcaggtgattgtagattgaggaacccatttcctcattctgcaaattgcaaacctgagggcccaaagagggacaggggcttgccccaggtctcagcaggctgtgagcaagagctaaagcctaatcctcctgcctttgggcctggagcccttccttgtaccccaggggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcagctcccgcctcaggccgagatgaggagcccttcagaatagctgctgtctctgggaggacccgggcgtccttggcagcccagctgctctggacaaagccctgccagtcaggcctccgctggcaggaaccatggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 108576 - DNA, 4778 bp, Homo sapiens
  Payload ID: 1332
  Gene Symbol: ARAP1
  Gene Name: ArfGAP with RhoGAP domain, ankyrin repeat and PH domain 1
  Uniprot ID: Q96P48
  ENST ID: ENST00000393605
  CDS Start-End: 557-4189
gcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 108577 - DNA, 5145 bp, Homo sapiens
  Payload ID: 1332
  Gene Symbol: ARAP1
  Gene Name: ArfGAP with RhoGAP domain, ankyrin repeat and PH domain 1
  Uniprot ID: Q96P48
  ENST ID: ENST00000393609
  CDS Start-End: 204-4556
aatttggcggtggcggtgtaagtcggtggcggcgccggtacgcctggtccccgcgtggagtctttactcaaaacagctcccgcctcaggccgagatgaggagcccttcagaatagctgctgtctctgggaggacccgggcgtccttggcagcccagctgctctggacaaagccctgccagtcaggcctccgctggcaggaaccatggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatatttt

SEQ ID NO: 108578 - DNA, 2683 bp, Homo sapiens
  Payload ID: 1332
  Gene Symbol: ARAP1
  Gene Name: ArfGAP with RhoGAP domain, ankyrin repeat and PH domain 1
  ENST ID: ENST00000455638
  CDS Start-End: 50-2089
ccttgccagtccttcagagccattgtagcaggaggcagagtacagagtgatagatgcttctggaaaaggagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccct

SEQ ID NO: 108579 - DNA, 4066 bp, Homo sapiens
  Payload ID: 1332
  Gene Symbol: ARAP1
  Gene Name: ArfGAP with RhoGAP domain, ankyrin repeat and PH domain 1
  ENST ID: ENST00000426523
  CDS Start-End: 406-3990
acctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggc

SEQ ID NO: 108580 - DNA, 994 bp, Homo sapiens
  Payload ID: 1332
  Gene Symbol: ARAP1
  Gene Name: ArfGAP with RhoGAP domain, ankyrin repeat and PH domain 1
  ENST ID: ENST00000452383
  CDS Start-End: 231-994
cccggctcctccacaaggcagaaggagcttgagatcctctggaggctctggctgactgggcagctgtgtccaggcagccagcaggggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttgggga

SEQ ID NO: 108581 - DNA, 3883 bp, Homo sapiens
  Payload ID: 1332
  Gene Symbol: ARAP1
  Gene Name: ArfGAP with RhoGAP domain, ankyrin repeat and PH domain 1
  Uniprot ID: Q96P48
  ENST ID: ENST00000429686
  CDS Start-End: 406-3807
acctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgaggcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggc

SEQ ID NO: 108582 - DNA, 1101 bp, Homo sapiens
  Payload ID: 1332
  Gene Symbol: ARAP1
  Gene Name: ArfGAP with RhoGAP domain, ankyrin repeat and PH domain 1
  ENST ID: ENST00000427971
  CDS Start-End: 180-1101
tctttcagtctgaggatggactgctccaggcctgggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagg

SEQ ID NO: 108583 - DNA, 699 bp, Homo sapiens
  Payload ID: 1332
  Gene Symbol: ARAP1
  Gene Name: ArfGAP with RhoGAP domain, ankyrin repeat and PH domain 1
  ENST ID: ENST00000542596
  CDS Start-End: 1-699
atgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtacttctgcgcaacgtctgagcacaggagcccatccttgg

SEQ ID NO: 108584 - DNA, 639 bp, Homo sapiens
  Payload ID: 1332
  Gene Symbol: ARAP1
  Gene Name: ArfGAP with RhoGAP domain, ankyrin repeat and PH domain 1
  ENST ID: ENST00000536885
  CDS Start-End: 1-535
gaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctgtgagtggctctccatgcctttgggcagggggctgggggcctggctgggtgcctgccttctactccacagtagatgattgccctgattgccctccccgattgccctccggccccctccctccagccttggtgggggccctcataggcctctttggttcacaccattcaaaggagccccttctgcctggccctggaagctgggagtcccctctgcctggccctgggagctgggagcctggctgattggagtgctccccggctggcagtggagagtggctgcagcagctgcagcagcttcagcggggcgccagcccctctgggccttcacaaaatacctgtgggtctct

SEQ ID NO: 108585 - DNA, 7514 bp, Homo sapiens
  Payload ID: 1333
  Gene Symbol: ARAP2
  Gene Name: ArfGAP with RhoGAP domain, ankyrin repeat and PH domain 2
  Uniprot ID: Q8WZ64
  ENST ID: ENST00000303965
  CDS Start-End: 491-5605
agcggcggccgaggcgaggcgcgggagcacctgagcaaggcgcgggcgccgggctcggcgtttccggagctgagcgcgggtccgcggcccgcgctccccgcctccaggtgcggcggccgcgacacgccggccccactaacagcgccgcccgcgcggccgccgccaggcagcagaggcgactgcggacagccggcggggaccgggaaagaggaggcctggcgcctccggcagaggggcgaggaccgagcgcccaaggctgggagagacgccggcgctgagcttcccagcgccgcctcacctcgcttttcgaactccgcgacccgagcgcaaggcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcagaaaattggaatatcacctacaggtcaccgtaggaggatacttaaacagttacagataatcttgtcaaaaatgcaagatattccaatatatgcaaatgttcataaaactaagaagaatgatgacccttcaaaggattaccatgttccatcttctgatcagaatatctgcatagaactttccaattctggtagtgttcagacatctagcccaccgcagttggagactgttagaaaaaatcttgaagacagtgatgcaagtgtggaaagaagccagtatcctcaatcagatgataagctgtctcctcctaaacgcgacttccccactgcagaggaaccacacctgaatttgggttctttgaatgattctttatttggtagtgacaatattaaaatagaatcattgattacaaagaagactgtggatcacacagttgaagaacaacaaacagaaaaagttaaattgatcacagaaaatctcagtaagctccctaatgcagactctgaatgcctttcttttgttggctgttcaacatcaggaacaaattctggaaatggaacaaatggtttattagaaggatcaccaccatccccattctttaagtttcaaggagaaatgattgtaaatgacttgtatgttccatcatcaccaatcctagcacctgtgagaagtcgtagcaagttggtttcaagaccatctcgatcttttctgctaagacatcgacctgtaccagagattccagggtcaacaaaaggagtttctgggagctatttccgtgaaagaagaaatgttgctacctcaactgaaaaatctgtggcatggcaaaattcaaatgaggagaattcatcttccatctttccttatggagagacctttctcttccagagactagaaaattccaagaagcgatctataaagaatgaatttttgacccagggagaagcactcaaaggggaagcagctactgcaacaaactcttttatcatcaaatcaagcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaaggaaaacgcatgtttcaaaagagatgggtgaaatttgatggccttagcatttcttactacaataatgagaaggagatgtattcgaaaggaataattcccctttctgctatatcaacagtacgagttcaaggagacaacaaatttgaagttgttacaacacaaagaacttttgtttttagagtagaaaaagaagaggagagaaatgactggatcagcatactattaaatgcactgaaatcacaatcccttacctcgcagtctcaagctgttgttacacctgagaaatgtggatatcttgaattgagaggctataaggcaaaaatttttactgtgttaagtggaaacagtgtgtggctttgcaaaaacgaacaggattttaagagtggacttggtattaccataattcctatgaatgtagcaaatgtaaagcaagtggaccgaactgtgaaacaatcttttgaaataatcactccctacaggagtttcagctttacagccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacgaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggtgtggtctcttccctgtacttatgaataaggacaaagccctatttttgtttccacataaagatcagctactgaattggtgaatttcctgacagacaatgctatctaaccatagttcatgttaggggaagcatttttccatcagtttctttaaaattggattgtctggtgagttttgatattaaacattatgtagctaagttttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctacttgaa

SEQ ID NO: 108586 - DNA, 631 bp, Homo sapiens
  Payload ID: 1333
  Gene Symbol: ARAP2
  Gene Name: ArfGAP with RhoGAP domain, ankyrin repeat and PH domain 2
  ENST ID: ENST00000506189
  CDS Start-End: 491-631
ggatccggatagacagctggacactccctccattcctctcccctacctttaaataagaagaagctgtagtgagtttcaggcaccaagttatttactcggtagagatcatgaatttgcccgggtgtctgtgctgccccgcaccctgcttgttaaccacgttaagacgactggcctgttaattaactttaattacgatcatttggcttccacctgcctgaacccgataccttacacgggaacctgtatgatgtgagtttaccagattgatctttcttgtttacttttggagacagttctcttgggagaagtggtgtccatcctatttaataaagcttaagcaggtaaagcagtcactgtgaagaaaataacattttaagaaacttttctgtcacaattgatagaggaaaagccagtagagaagtacatcttcttgtgtgtgtgtctcatcgtgccactttttgtaactcagcttagtaatgaagccaccattatgtcctcagtcagtgaagtaaatgtggatataaaagatttcctaatgagcattaatttggagcagtatctcttacatttccatgagtctggttttactactgtgaaggactgtgcagcaataaatgacagcctgctgcag

SEQ ID NO: 108587 - DNA, 396 bp, Homo sapiens
  Payload ID: 1333
  Gene Symbol: ARAP2
  Gene Name: ArfGAP with RhoGAP domain, ankyrin repeat and PH domain 2
  ENST ID: ENST00000511416
  CDS Start-End: 245-396
agcatatacgataacagaaaggagaaaataagcgaggacaaggtggaagatatttggatacctcgagaggacaaaaacaattttttgatagacactgcttctgaatcagaatactcaacagtagaagaatgctttcagagtttaagaagaaaaaattcaaaggcatctaaatctaggactcaaaaagccttgattttggactccgttaataggcacagttatccgttaagctcaacaagtggaaatgctgattcatcagccgtttcttcacaggcaatatctccctatgcctgcttttatggagcatctgcaaagaaggttaaatcaggatggctggataaactctctcctcaagggaaatttgattttgaataaaccaaagcagattacttctta

SEQ ID NO: 108588 - DNA, 2592 bp, Homo sapiens
  Payload ID: 1333
  Gene Symbol: ARAP2
  Gene Name: ArfGAP with RhoGAP domain, ankyrin repeat and PH domain 2
  ENST ID: ENST00000618163
  CDS Start-End: 1-2592
atggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacgaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaatattgagagtgcaagagcagaacttgaaaggctgcggctcagtgaaaagtgtgataaagagtccgtggactctagcttaa

SEQ ID NO: 108589 - DNA, 5250 bp, Homo sapiens
  Payload ID: 1334
  Gene Symbol: ARAP3
  Gene Name: ArfGAP with RhoGAP domain, ankyrin repeat and PH domain 3
  Uniprot ID: Q8WWN8
  ENST ID: ENST00000239440
  CDS Start-End: 67-4701
ctcggacgagcggcgggcacccgcgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 108590 - DNA, 1765 bp, Homo sapiens
  Payload ID: 1334
  Gene Symbol: ARAP3
  Gene Name: ArfGAP with RhoGAP domain, ankyrin repeat and PH domain 3
  ENST ID: ENST00000504448
  CDS Start-End: 346-1765
gtgcagtcaggcaggagcagagctttgacccagacccagggtgggcaggaactgaggggccaactctagcactgacttactgtgaacctggggcaagccccttcccctctctgggcctcagtttccttaacttcaaatgaagtcccttccctaagtagagagccattgctgttgttctgggatggctctgcttccagatcgcaggcctttcagcatctttctttggaggaagattggaggctggtgctcactgtccaggcctcagactctggggcagagagggggattctcagcctgagccctcccttcaccctgcccctccccccagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagct

SEQ ID NO: 108591 - DNA, 3810 bp, Homo sapiens
  Payload ID: 1334
  Gene Symbol: ARAP3
  Gene Name: ArfGAP with RhoGAP domain, ankyrin repeat and PH domain 3
  Uniprot ID: Q8WWN8
  ENST ID: ENST00000513878
  CDS Start-End: 70-3651
atgggtcattgagctctctctctccaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcc

SEQ ID NO: 108592 - DNA, 4927 bp, Homo sapiens
  Payload ID: 1334
  Gene Symbol: ARAP3
  Gene Name: ArfGAP with RhoGAP domain, ankyrin repeat and PH domain 3
  ENST ID: ENST00000508305
  CDS Start-End: 251-4378
acccgcgagcggacggcggccgcgtagtgaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaagac

SEQ ID NO: 108593 - DNA, 4928 bp, Homo sapiens
  Payload ID: 1334
  Gene Symbol: ARAP3
  Gene Name: ArfGAP with RhoGAP domain, ankyrin repeat and PH domain 3
  ENST ID: ENST00000626478
  CDS Start-End: 254-4381
agcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaag

SEQ ID NO: 108594 - DNA, 6344 bp, Homo sapiens
  Payload ID: 1335
  Gene Symbol: ASAP1
  Gene Name: ArfGAP with SH3 domain, ankyrin repeat and PH domain 1
  ENST ID: ENST00000357668
  CDS Start-End: 352-3720
cccttcctgcgccgcgctcggctcccgcgcctcgcctggcctggccgctgccgcgggcgagcactgtgcgctgggcagccccgggcccgcgcctcccgcccagccggcgcttcccggtcgcagttcgctttcccacccgagagccgcgagcgcccggccgaacccgcgatggaataatgcccagcggcccgccaggtcccggtcgttttctgatgtgacggctgagacatgagatcttcagcctccaggctctccagtttttcgtcgagagattcactatggaatcgatatccaggaatgattttcagagtatttgagaaaatgagaggtgcagatggttttcactgaggcatggtttcaaatttaaagaggattatggcccagaaatggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatccc

SEQ ID NO: 108595 - DNA, 5406 bp, Homo sapiens
  Payload ID: 1335
  Gene Symbol: ASAP1
  Gene Name: ArfGAP with SH3 domain, ankyrin repeat and PH domain 1
  ENST ID: ENST00000521075
  CDS Start-End: 26-145
cgttttctgatgtgacggctgagacatgagatcttcagcctccaggctctccagtttttcgtcgagagattcactatggaatcgatatccaggaatgattttcagagtatttgagaaaatgagaggtgcagatggttttcactgaggcatggtttcaaatttaaagaggattatggcccagaaatggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcat

SEQ ID NO: 108596 - DNA, 742 bp, Homo sapiens
  Payload ID: 1335
  Gene Symbol: ASAP1
  Gene Name: ArfGAP with SH3 domain, ankyrin repeat and PH domain 1
  ENST ID: ENST00000520927
  CDS Start-End: 97-216
cattgcattgagaggatattcaaactgaaggggagaagcacggattctgaaggatgaaaaaggaacaatgtcgttttctgatgtgacggctgagacatgagatcttcagcctccaggctctccagtttttcgtcgagagattcactatggaatcgatatccaggaatgattttcagagtatttgagaaaatgagaggtgcagatggttttcactgaggcatggtttcaaatttaaagaggattatggcccagaaatggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgaga

SEQ ID NO: 108597 - DNA, 566 bp, Homo sapiens
  Payload ID: 1335
  Gene Symbol: ASAP1
  Gene Name: ArfGAP with SH3 domain, ankyrin repeat and PH domain 1
  ENST ID: ENST00000520342
  CDS Start-End: 468-566
gtttgtagccgtggctttacacctctcaagatggtagcttgccgcgtgataggctatgtttcttccaagaggcaaaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagtt

SEQ ID NO: 108598 - DNA, 5478 bp, Homo sapiens
  Payload ID: 1335
  Gene Symbol: ASAP1
  Gene Name: ArfGAP with SH3 domain, ankyrin repeat and PH domain 1
  ENST ID: ENST00000524124
  CDS Start-End: 1-2851
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatcccaaa

SEQ ID NO: 108599 - DNA, 550 bp, Homo sapiens
  Payload ID: 1335
  Gene Symbol: ASAP1
  Gene Name: ArfGAP with SH3 domain, ankyrin repeat and PH domain 1
  ENST ID: ENST00000524299
  CDS Start-End: 106-225
ttcgctttcccacccgagagccgcgagcgcccggccgaacccgcgatggaataatgcccagcggcccgccaggtcccggtcgttttctgatgtgacggctgagacatgagatcttcagcctccaggctctccagtttttcgtcgagagattcactatggaatcgatatccaggaatgattttcagagtatttgagaaaatgagaggtgcagatggttttcactgaggcatggtttcaaatttaaagaggattatggcccagaaatggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttg

SEQ ID NO: 108600 - DNA, 1449 bp, Homo sapiens
  Payload ID: 1335
  Gene Symbol: ASAP1
  Gene Name: ArfGAP with SH3 domain, ankyrin repeat and PH domain 1
  ENST ID: ENST00000519483
  CDS Start-End: 1-1449
agagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcct

SEQ ID NO: 108601 - DNA, 5507 bp, Homo sapiens
  Payload ID: 1335
  Gene Symbol: ASAP1
  Gene Name: ArfGAP with SH3 domain, ankyrin repeat and PH domain 1
  Uniprot ID: Q9ULH1
  ENST ID: ENST00000518721
  CDS Start-End: 229-3618
cccttcctgcgccgcgctcggctcccgcgcctcgcctggcctggccgctgccgcgggcgagcactgtgcgctgggcagccccgggcccgcgcctcccgcccagccggcgcttcccggtcgcagttcgctttcccacccgagagccgcgagcgcccggccgaacccgcgatggaataatgcccagcggcccgccaggtcccggtcgttttctgatgtgacggctgagacatgagatcttcagcctccaggctctccagtttttcgtcgagagattcactatggaatcggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaattttttaagtcgagacaaccccgaccttggcaccgcgtttgtcaagttttctactcttacaaaggaactgtccacactgctgaaaaatctgctccagggtttgagccacaatgtgatcttcaccttggattctttgttaaaaggagacctaaagggagtcaaaggagatctcaagaagccatttgacaaagcctggaaagattatgagacaaagtttacaaaaattgagaaagagaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctatcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcat

SEQ ID NO: 108602 - DNA, 566 bp, Homo sapiens
  Payload ID: 1335
  Gene Symbol: ASAP1
  Gene Name: ArfGAP with SH3 domain, ankyrin repeat and PH domain 1
  ENST ID: ENST00000521426
  CDS Start-End: 272-566
ggtgcaaacatgcttgccaagctgaagtgtggagtgacagtttttggctgagccatgaacctaaaagtggaggtttacaaagttactgcagacaggtcattagcacgactggctgcagtgagctccctaagtcttcatcgctcctgccttttcatcagcagcgagataattgactgttagactcccgagccacagaccacggcagagatatccaggaatgattttcagagtatttgagaaaatgagaggtgcagatggttttcactgaggcatggtttcaaatttaaagaggattatggcccagaaatggatgccggaccagatctctgtctcggagttcatcgccgagaccaccgaggactacaactcgcccaccacgtccagcttcaccacgcggctgcacaactgcaggaacaccgtcacgctgctggaggaggctctagaccaagatagaacagcccttcagaaagtgaagaagtctgtaaaagcaatatataattctggtcaagatcatgtacaaaatgaagaaaactatgcacaagttcttgataagtttgggagtaatt

SEQ ID NO: 108603 - DNA, 5712 bp, Homo sapiens
  Payload ID: 1336
  Gene Symbol: ASAP2
  Gene Name: ArfGAP with SH3 domain, ankyrin repeat and PH domain 2
  Uniprot ID: O43150
  ENST ID: ENST00000281419
  CDS Start-End: 341-3361
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgacctcatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatgga

SEQ ID NO: 108604 - DNA, 5582 bp, Homo sapiens
  Payload ID: 1336
  Gene Symbol: ASAP2
  Gene Name: ArfGAP with SH3 domain, ankyrin repeat and PH domain 2
  Uniprot ID: O43150
  ENST ID: ENST00000315273
  CDS Start-End: 341-3226
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgacctcatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggacatgg

SEQ ID NO: 108605 - DNA, 4050 bp, Homo sapiens
  Payload ID: 1337
  Gene Symbol: ASAP3
  Gene Name: ArfGAP with SH3 domain, ankyrin repeat and PH domain 3
  Uniprot ID: Q8TDY4
  ENST ID: ENST00000336689
  CDS Start-End: 46-2757
gtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 108606 - DNA, 2865 bp, Homo sapiens
  Payload ID: 1337
  Gene Symbol: ASAP3
  Gene Name: ArfGAP with SH3 domain, ankyrin repeat and PH domain 3
  Uniprot ID: Q8TDY4
  ENST ID: ENST00000437606
  CDS Start-End: 47-2731
agtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggcttctctttccttggggtctagggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctg

SEQ ID NO: 108607 - DNA, 907 bp, Homo sapiens
  Payload ID: 1337
  Gene Symbol: ASAP3
  Gene Name: ArfGAP with SH3 domain, ankyrin repeat and PH domain 3
  ENST ID: ENST00000484418
  CDS Start-End: 1-373
gcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggtgagaacccctccaagggccacttataacccacctgtctaacatattccccagttcttctccaggaccagctgttactcccctccaccccacctctgacatctgctcagatctcacccatcagagtggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacct

SEQ ID NO: 108608 - DNA, 936 bp, Homo sapiens
  Payload ID: 1337
  Gene Symbol: ASAP3
  Gene Name: ArfGAP with SH3 domain, ankyrin repeat and PH domain 3
  ENST ID: ENST00000465372
  CDS Start-End: 1-612
ctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagaatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttccc

SEQ ID NO: 108609 - DNA, 3024 bp, Homo sapiens
  Payload ID: 1337
  Gene Symbol: ASAP3
  Gene Name: ArfGAP with SH3 domain, ankyrin repeat and PH domain 3
  ENST ID: ENST00000492982
  CDS Start-End: 52-186
agctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccgatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaaggtgggtcccagccctgtccctcaggcctctggatggcagaaggaaagagccagattgggcctgcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgcta

SEQ ID NO: 108610 - DNA, 2552 bp, Homo sapiens
  Payload ID: 1337
  Gene Symbol: ASAP3
  Gene Name: ArfGAP with SH3 domain, ankyrin repeat and PH domain 3
  Uniprot ID: Q8TDY4
  ENST ID: ENST00000495646
  CDS Start-End: 36-1259
cgtctattttcctacgactccagctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 108611 - DNA, 805 bp, Homo sapiens
  Payload ID: 1337
  Gene Symbol: ASAP3
  Gene Name: ArfGAP with SH3 domain, ankyrin repeat and PH domain 3
  ENST ID: ENST00000475814
  CDS Start-End: 1-363
tatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctggg

SEQ ID NO: 108612 - DNA, 589 bp, Homo sapiens
  Payload ID: 1337
  Gene Symbol: ASAP3
  Gene Name: ArfGAP with SH3 domain, ankyrin repeat and PH domain 3
  ENST ID: ENST00000608765
  CDS Start-End: 117-589
gaggaggatttggaagacccagagcgggatgaaacgggacagagccctgaaggggcagggatgggggaaggcggaggagtttctactgaggccagggctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaat

SEQ ID NO: 108613 - DNA, 2226 bp, Homo sapiens
  Payload ID: 1337
  Gene Symbol: ASAP3
  Gene Name: ArfGAP with SH3 domain, ankyrin repeat and PH domain 3
  ENST ID: ENST00000618240
  CDS Start-End: 113-721
aggatttggaagacccagagcgggatgaaacgggacagagccctgaaggggcagggatgggggaaggcggaggagtttctactgaggccagggctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctgggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 108614 - DNA, 2552 bp, Homo sapiens; identical to SEQ ID NO: 108610
  Payload ID: 1337
  Gene Symbol: ASAP3
  Gene Name: ArfGAP with SH3 domain, ankyrin repeat and PH domain 3
  ENST ID: ENST00000634513
  CDS Start-End: 36-1259

SEQ ID NO: 108615 - DNA, 4050 bp, Homo sapiens; identical to SEQ ID NO: 108605
  Payload ID: 1337
  Gene Symbol: ASAP3
  Gene Name: ArfGAP with SH3 domain, ankyrin repeat and PH domain 3
  ENST ID: ENST00000634561
  CDS Start-End: 46-2757

SEQ ID NO: 108616 - DNA, 2865 bp, Homo sapiens; identical to SEQ ID NO: 108606
  Payload ID: 1337
  Gene Symbol: ASAP3
  Gene Name: ArfGAP with SH3 domain, ankyrin repeat and PH domain 3
  ENST ID: ENST00000635198
  CDS Start-End: 47-2731

SEQ ID NO: 108617 - DNA, 805 bp, Homo sapiens; identical to SEQ ID NO: 108611
  Payload ID: 1337
  Gene Symbol: ASAP3
  Gene Name: ArfGAP with SH3 domain, ankyrin repeat and PH domain 3
  ENST ID: ENST00000634883
  CDS Start-End: 1-363

SEQ ID NO: 108618 - DNA, 589 bp, Homo sapiens; identical to SEQ ID NO: 108612
  Payload ID: 1337
  Gene Symbol: ASAP3
  Gene Name: ArfGAP with SH3 domain, ankyrin repeat and PH domain 3
  ENST ID: ENST00000634548
  CDS Start-End: 117-589

SEQ ID NO: 108619 - DNA, 907 bp, Homo sapiens; identical to SEQ ID NO: 108607
  Payload ID: 1337
  Gene Symbol: ASAP3
  Gene Name: ArfGAP with SH3 domain, ankyrin repeat and PH domain 3
  ENST ID: ENST00000635167
  CDS Start-End: 1-373

SEQ ID NO: 108620 - DNA, 2226 bp, Homo sapiens; identical to SEQ ID NO: 108613
  Payload ID: 1337
  Gene Symbol: ASAP3
  Gene Name: ArfGAP with SH3 domain, ankyrin repeat and PH domain 3
  ENST ID: ENST00000635693
  CDS Start-End: 113-721

SEQ ID NO: 108621 - DNA, 936 bp, Homo sapiens; identical to SEQ ID NO: 108608
  Payload ID: 1337
  Gene Symbol: ASAP3
  Gene Name: ArfGAP with SH3 domain, ankyrin repeat and PH domain 3
  ENST ID: ENST00000635461
  CDS Start-End: 1-612

SEQ ID NO: 108622 - DNA, 3024 bp, Homo sapiens; identical to SEQ ID NO: 108609
  Payload ID: 1337
  Gene Symbol: ASAP3
  Gene Name: ArfGAP with SH3 domain, ankyrin repeat and PH domain 3
  ENST ID: ENST00000634705
  CDS Start-End: 52-186

SEQ ID NO: 108623 - DNA, 14877 bp, Homo sapiens
  Payload ID: 1338
  Gene Symbol: ARFGEF3
  Gene Name: ARFGEF family member 3
  Uniprot ID: Q5TH69
  ENST ID: ENST00000251691
  CDS Start-End: 167-6700
ccgcggcatggagcgggcgtgattcatcagcatccgcgccggggcggcatgggggcgcgcgcggcggccgcctaggcgcccagggccaggcagcggcggcttccccggcccggctcgcccgcgcttctctccctgtgggcggcggcccggcgcctggaaggtcaagatggaagaaatcctgaggaagctgcagaaggaggcgtccgggagcaagtacaaagccatcaaggagagctgcacctgggccctggaaactctaggtggtctggataccattgtcaagatccctccacatgtactgagggagaaatgcctgctgcctctccagttggctttggaatccaagaatgtgaagctggcccaacatgctttggcagggatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttttactatgcatcacctacacgccaacatttgatctgaatgggagtgccgtgctgaagatcgcggaggtgtgcattgagacgtacataagcagctgtcaccagcgtagcataaacactgctgtgcgggcaactctcagtcaaatgctgagtgacttgactttacagttacgacagaggcaggagaatacgataattgaaaacccagatgtcccacaggatttcgggaatcaagggtcaacagtagagtccctctgtgatgatgttgtctctgtactcaccgtcctgtgtgagaagctgcaagccgccataaatgacagccagcagctgcagcttctctacctggagtgcatcctgtctgtgctcagcagctcctcctcctccatgcacctgcacaggcgcttcacggacctgatctggaaaaacctctgccctgctctcatcgtgatcttggggaatccaattcatgacaaaaccatcacctctgctcacaccagcagcaccagtaccagcctggagtcggactctgcgtctccgggagtgtctgaccacggccgaggatcaggctgctcctgcactgcgccggccctgagcggacctgtggctcggactatctattacatcgcagccgagctggtccggctggtggggtctgtggactccatgaagcccgtgctccagtccctctaccaccgagtgctgctctaccccccaccccagcaccgggtggaagccatcaaaataatgaaagagatacttgggagcccacagcgtctctgtgacttggcaggacccagctccactgaatcagagtccagaaaaagatcaatttcaaaaagaaagtctcatctggatctcctcaaactcatcatggatggcatgaccgaagcatgcatcaagggtggcatcgaagcttgctatgcagccgtgtcctgtgtctgcaccttgctgggtgccctggatgagctcagccaggggaagggcttgagcgaaggtcaggtgcaactgctgcttctgcgccttgaggagctgaaggatggggctgagtggagccgagattccatggagatcaatgaggctgacttccgctggcagcggcgagtgctgtcctcagaacacacgccgtgggagtcagggaacgagaggagccttgacatcagcatcagtgtcaccacagacacaggccagaccactctcgagggagagttgggtcagactacacccgaggaccattcgggaaaccacaagaacagtctcaagtcgccagccatcccagagggtaaggagacgctgagcaaagtattggaaacagaggcggtagaccagccagatgtcgtgcagagaagccacacggtcccttaccctgacataactaacttcctgtcagtagactgcaggacaaggtcctatggatctaggtatagtgagagcaattttagcgttgatgaccaagacctttctaggacagagtttgattcctgtgatcagtactctatggcagcagaaaaggactcgggcaggtccgacgtgtcagacattgggtcggacaactgttcactagccgatgaagagcagacaccccgggactgcctaggccaccggtccctgcgaactgccgccctgtctctaaaactgctgaagaaccaggaggcggatcagcacagcgccaggctgttcatacagtccctggaaggcctcctccctcggctcctgtctctctccaatgtagaggaggtggacaccgctctgcagaactttgcctctactttctgctcaggcatgatgcactctcctggctttgacgggaatagcagcctcagcttccagatgctgatgaacgcagacagcctctacacagctgcacactgcgccctgctcctcaacctgaagctctcccacggtgactactacaggaagcggccgaccctggcgccaggcgtgatgaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccgatattgacggcttagagagcagtgccattggtggccagctgatggcctcggctgctacagagtctcctttcgcccagagcaggagaattgatgactccacagtggcaggcgtggcatttgctcgctatattctggtgggctgctggaagaacttgatcgatactttatcaaccccactgactggtcgaatggcggggagctccaaagggctggccttcattctgggagctgaaggcatcaaagagcagaaccagaaggagcgggacgccatctgcatgagcctcgacgggctgcggaaagccgcacggctgagctgcgctctaggcgttgctgctaactgcgcctcagcccttgcccagatggcagctgcctcctgtgtccaagaagaaaaagaagagagggaggcccaagaacccagtgatgccatcacacaagtgaaactaaaagtggagcagaaactggagcagattgggaaggtgcagggggtgtggctgcacactgcccacgtcttgtgcatggaggccatcctcagcgtaggcctggagatgggaagccacaacccggactgctggccacacgtgttcagggtgtgtgaatacgtgggcaccctggagcacaaccacttcagcgatggtgcctcgcagccccctctgaccatcagccagccccagaaggccactggaagcgctggcctccttggggaccccgagtgtgagggctcgccccccgagcacagcccggagcaggggcgctccctgagcacggcccctgtcgtccagcccctgtccatccaggacctcgtccgggaaggcagccggggtcgggcctccgacttccgcggcgggagcctcatgagcgggagcagcgcggccaaggtggtgctcaccctctccacgcaagccgacaggctctttgaagatgctacggataagttgaacctcatggccttgggaggttttctttaccagctgaagaaagcatcgcagtctcagcttttccattctgttacagatacagttgattactctctggcaatgccaggagaagttaaatccactcaagaccgaaaaagcgccctccacctgttccgcctggggaatgccatgctgaggattgtgcggagcaaagcacggcccctgctccacgtgatgcgctgctggagccttgtggccccacacctggtggaggctgcttgccataaggaaagacatgtgtctcagaaggctgtttccttcatccatgacatactgacagaagtcctcactgactggaatgagccacctcattttcacttcaatgaagcactcttccgacctttcgagcgcattatgcagctggaattgtgtgatgaggacgtccaagaccaggttgtcacatccattggtgagctggttgaagtgtgttccacgcagatccagtcgggatggagacccttgttcagtgccctggaaacagtgcatggcgggaacaagtcagagatgaaggagtacctggttggtgactactccatgggaaaaggccaagctccagtgtttgatgtatttgaagcttttctcaatactgacaacatccaggtctttgctaatgcagccactagctacatcatgtgccttatgaagtttgtcaaaggactgggggaggtggactgtaaagagattggagactgtgccccagcacccggagccccgtccacagacctgtgcctcccggccctggattacctcaggcgctgctctcagttattggccaaaatctacaaaatgcccttgaagccaatattccttagtgggagacttgccggcttgcctcgaagacttcaggaacagtcagccagcagtgaggatggaattgaatcagtcctgtctgattttgatgatgacaccggtctgatagaagtctggataatcctgctggagcagctgacagcggctgtgtccaattgtccacggcagcaccaaccaccaactctggatttactctttgagctgttgagagatgtgacgaaaacaccaggaccagggtttggtatctatgcagtggttcacctcctccttcctgtgatgtccgtttggctccgccggagccataaagaccattcctactgggatatggcctctgccaatttcaagcacgctattggtctgtcctgtgagctggtggtggagcacattcaaagctttctacattcagatatcaggtacgagagcatgatcaataccatgctgaaggacctctttgagttgctggtcgcctgtgtggccaagcccactgaaaccatctccagagtgggctgctcctgtattagatacgtccttgtgacagcgggccctgtgttcactgaggagatgtggaggcttgcctgctgtgccctgcaagatgcgttctctgccacactcaagccagtgaaggacctgctgggctgcttccacagcggcacggagagcttcagcggggaaggctgccaggtgcgagtggcggccccgtcctcctccccaagtgccgaggccgagtactggcgcatccgagccatggcccagcaggtgtttatgctggacacccagtgctcaccaaagacaccaaacaactttgaccacgctcagtcctgccagctcattattgagctgcctcctgatgaaaaaccaaatggacacaccaagaaaagcgtgtctttcagggaaattgtggtgagcctgctgtctcatcaggtgttactccagaacttatatgacatcttgttagaagagtttgtcaaaggcccctctcctggagaggaaaagacgatacaagtgccagaagccaagctggctggcttcctcagatacatctctatgcagaacttggcagtcatattcgacctgctgctggactcttataggactgccagggagtttgacaccagccccgggctgaagtgcctgctgaagaaagtgtctggcatcgggggcgccgccaacctctaccgccagtctgcgatgagctttaacatttatttccacgccctggtgtgtgctgttctcaccaatcaagaaaccatcacggccgagcaagtgaagaaggtcctttttgaggacgacgagagaagcacggattcttcccagcagtgttcatctgaggatgaagacatctttgaggaaaccgcccaggtcagccccccgagaggcaaggagaagagacagtggcgggcacggatgcccttgctcagcgtccagcctgtcagcaacgcagattgggtgtggctggtcaagaggctgcacaagctgtgcatggaactgtgcaacaactacatccagatgcacttggacctggagaactgtatggaggagcctcccatcttcaagggcgacccgttcttcatcctgccctccttccagtccgagtcatccaccccatccaccgggggcttctctgggaaagaaaccccttccgaggatgacagaagccagtcccgggagcacatgggcgagtccctgagcctgaaggccggtggtggggacctgctgctgccccccagccccaaagtggagaagaaggatcccagccggaagaaggagtggtgggagaatgcggggaacaaaatctacaccatggcagccgacaagaccatttcaaagttgatgaccgaatacaaaaagaggaaacagcagcacaacctgtccgcgttccccaaagaggtcaaagtggagaagaaaggagagccactgggtcccaggggccaggactccccgctgcttcagcgtccccagcacttgatggaccaagggcaaatgcggcattccttcagcgcaggccccgagctgctgcgacaggacaagaggccccgctcaggctccaccgggagctccctcagtgtctcggtgagagacgcagaagcacagatccaggcatggaccaacatggtgctaacagttctcaatcagattcagattctcccagaccagaccttcacggccctccagcccgcagtgttcccgtgcatcagtcagctgacctgtcacgtgaccgacatcagagttcgccaggctgtgagggagtggctgggcagggtgggccgtgtctatgacatcattgtgtagccgactcctgttctactctcccaccaaataacagtagtgagggttagagtcctgccaatacagctgttgcattttccccaccactagccccacttaaactactactactgtctcagagaacagtgtttcctaatgtaaaaagcctttccaaccactgatcagcattggggccatactaaggtttgtatctagatgacacaaacgatattctgattttgcacattattatagaagaatctataatccttgatatgtttctaactcttgaagtatatttcccagtgcttttgcttacagtgttgtccccaaatgggtcattttcaaggattactcatttgaaaacactatattgatccatttgatccatcatttaaaaaataaatacaattcctaaggcaatatctgctggtaagtcaagctgataaacactcagacatctagtaccagggattattaattggaggaagatttatggttatgggtctggctgggaagaagacaactataaatacatattcttgggtgtcataatcaagaaagaggtgacttctgttgtaaaataatccagaacacttcaaaattattcctaaatcattaagattttcaggtattcaccaatttccccatgtaaggtactgtgttgtacctttatttctgtatttctaaaagaagaaagttctttcctagcagggtttgaagtctgtggcttatcagcctgtgacacagagtacccagtgaaagtggctggtacgtagattgtcaagagacataagaccgaccagccaccctggctgttcttgtggtgtttgtttccatccccaaggcaaacaaggaaaggaaaggaaagaagaaaaggtgccttagtcctttgttgcacttccatttccatgccccacaattgtctgaacataaggtatagcatttggtttttaagaaaacaaaacattaagacgcaactcattttatatcaacacgcttggaggaaagggactcagggaagggagcagggagtgtggggtggggatggattatgatgaaatcattttcaatcttaaaatataatacaacaatcttgcaaaattatggtgtcagttacacaagctctagtctcaaaatgaaagtaatggagaaagacactgaaatttagaaaattttgtcgatttaaaatatttctcctatctaccaagtaaagttaccctatgtttgatgtctttgcattcagaccaatatttcaggtggatatttctaagtattactagaaaatacgtttgaaagctttatcttattatttacagtatttttatatttcttacattatcctaatgattgaaaactcctcaatcaagcttacttacacacattctacagagttatttaaggcatacattataatctcccagccccattcataatgaataagtcaccctttaaatataagacacaaattctacagtattgaaataaggatttaaaggggtatttgtaaactttgccctccttgagaaatatggaactaccttagaggttaagaggaaggcagtgttctgacttctttaggtgatctgaaaaaaacacccttatcatccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggaggccaaggtgggcagataacctgcggtcaggagtttgagaccaggctggacaacatggtgaaacctcgtctctactaaaaatacaaaaattagccaggtgtggtaggatgcacctgtaatcccagctacttaggaggccgagacaggagaatcgctcgaacccaggaggcggacgttgcagtgagccaagattgcaccattgcactccagactgggtgacaagagtgaaactccatctaaaaaaaaaaaaaaaaaaaagtgaatactgtatcccaaagtatgttagttgtttgtttggaaatcagcattctccccgatgctctattatgggatccaaaattcttgaacataagtttaccctgtactgtgtccaaacactgttctagttctagcctgattatgggtcccaagaataaaaggatgagtaggtgtacagagctcttgacctacaattttttaagagtgttttggtaccttcccattgtcttctctataactcagtcctaacatactctgcactcgagttaccagccatccacactgacatcagatttcaaccagaaccatcactgagtgacagcagtacttctcagaggtatttgcagcttgatgcaaagtagtctctaatgagtaggcattcaggtggttcttcccagcaggtggagaagaaagggaggagatgaagaacactgagaggggagtggcaccttcccaggctgcccagctcagtctcttgccctgttcctgtgactcagctgcccactcccccaactttgtttccctccctcccagtctctgaaagtgtcaggtgtttctctcctcacagtctcttttgcagcaacagtaagacaaaattcaaggcagccttttaaagttacgaacagttattagcatgtatttacagacctaagcagaatgagagtttatacattgtttttagttgcctgtatttatagccaaaagtatattaccttaaagttgagatctttctcttcttttcctaaattttggtaaagtgtgcttcatgaaacaaacatctggaaaactccaagtataagagaccctggactgatgatggcccagccaagtatatggagggacagagttctctctgtcattaatgaggacatcggttttcacaattgaacctcatgcactgtccacagcatctcacctagctcctgtatctcctgatctgcttttaaaaatagttagttaggctgcctttttacaccaccttctctctctccccttgtggtaattttccagccttccccatagatataaaactagaacacctttatgatttggggtctatgtaatgactgaccgataagaacccaggcagatgctaacatacttaacagctcgcattaaaatactttaaatcaggcgtgatggctcattcctgtaatctcaagcactttgggaggctaaggtgggtggatctcttgaggtcaggagttcgagaccaacctggccaacgtggtgaaaccccgtctctactaaaaatacaaaattagccgggcatggtggcagctgcctgtaatcccagctactcgggaagctgaggcaggagaattgcttgaacctgggaggtggggattgcagtcagccaagattgttctgcagcatgggtgacaaagtgagacttcgtctcaagtaaataaaactaaaatttttaaatcaaacatgacaaaaatgttaatataattcagaagtaccttgaaattgaaacatatttgtgcaatgatcattaggctttttgtccttgttgttttaaaatgaggcttatacagagtgagttgagagtcaagtagccttcgctgtgagacggtaatgcagttatataatagatacccttgactttgccagattcatcacaatactgcttatacaggaaagttttctcagaaaggaaaatccattagtatcagtcccatcaagccaaacagaatgaagacctttgatagtaatagcaagaggttacaaatagcagggaggaggcgagtagtgaatgtcactgtgattgcaaacccttacctgtattatcacacgtagtcctcacaacaaccttgtgagacaagtgttgtgttcctcattttttcagaggggaacacagacccagagaggttaagaaatttgcccaagataacaagtaaaaggcaaagttggttgcaaaagaggtgtttctgaattcaagggccatactctctctctgacaacatgctctaagtccatagagtaagcactctagtatgaaaaaaagtttcaaggaacgaggccatgaaaatgagactatttgacatctcagatctgtctgggatgttatggaggtttttaaaaataaagttgaaaaaagaaaatgaatcatgtttatacataaaaaaatcacatgtaacacatttcaagtgtttgaaaataaaaccaaaatctaaactttagtcttcaagcagacattcagtgttactttagaaaactcactgaattaggtggaaatgatggaataatactattcatggccagctattaacacagaagaacatggcagtgtgtgtctggaacggcatgcacaatttgtaaacctttttcaaatatcatttaatcaactcagaataaagtgccctgtagccaacagtgcctctttacttgcttctctgggaaatacatggtactaaattagtagcacaaagtttgggaatatgcaaaataatggataaccatttttcaaaatgtacattctctgaagaggaagcagctggttggacaggatttcttgaagagccaggtgctaagggcatcaggtcgacatccatagtaaccatgtgccataacatctacacatttccacttgttttacagacaaggtaacaggcagaaggaaaatccagagtcttgcagtaagcagatgacaaaacttcaatatgcttgggcaccacttaggtgaccccagggagatttagtgtggccttaggaaagcaaaagagcactttttattggaaatatgagcttgtcactgggaaagatttgtaaaattgatcaagaacttgatttataattatgcctcaaaaaaaaaagttctcatttagtagtggagcaatctagaaaacataccttttttgtttgtttggaagatcctctttccctggctgtattgtagtgtttgctatttgatgtggaaataactaataacttaagattttggaacagaacaccctttagatttccaaaacacaattcttatttcagggaagacagaccaaaaatatctcctgagatcattggtttctttataaattgtggtaccactccatcattgaagagaaaccactaccacaccactagcaccatacagaaccttttctctgtatctttgtacaatactacaaaggggtaccagggaggagagagtggctgaccactttagtgacaaaacagcactccactgctggtgaatcccatctaattatggtccttccacccttttcaaccaccaacaactgttcgtactgttaattcctatcctgaaggtttaaccagtggttgtctagtatcttctgtctttagaacagtggttctcaaactttagtacacatcagcatcacctggagggcctttttttaaaataagacacagattgctgggctcatggtcagagttcccagttaagtaaatcaggaaatttgtatttctaacaagtttataggtgaggccaatactgctgttttgggaactatgctttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgttgatgatatcaaggagacaatctacagagtttttgcctctgtggatggaaataagggtgtttttttttggttttttttttactttagtttcccataatttttggaaattatgtgtgcatttagttcttttagtaacactgattttaaaattaaatttcaaaagtcaatctctaagagtaatttatttttgttttaccaaccagtgccaaaaaggagaggagggaatccaaaagccaatcttttgaaccaatgtgtaaaagattatgttttttcttaaagttagggaggctcgggccctgacactgccagccccagtgagcatccctggctacctcgggattatgtgcaagctgctttgtcctacatttctttcatctggttcttattgggagtgcttctctctaataaaaattgatttcccacaaaataggcaaagctgaacaaagatgaatgcttttgataagttgggtttcacttcagttgaaacaatgtgatagaatatccaggtgtggcatgatggggcaggaggaggtgcctagagggaaaagttatttttgtttcttagtgttgtgttgtggggatgggacagataagaataagatgtttattgccctaatcatgctaagagactattattcaatatgcttttcccgcttttctaagaggaataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcattaaaaatctggtacatgaaacaattgtgtttactgaataaatatatataaata

SEQ ID NO: 108624 - DNA, 1468 bp, Homo sapiens
  Payload ID: 1339
  Gene Symbol: ARG1
  Gene Name: arginase 1
  Uniprot ID: P05089
  ENST ID: ENST00000356962
  CDS Start-End: 59-1051
tgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataac

SEQ ID NO: 108625 - DNA, 1532 bp, Homo sapiens
  Payload ID: 1339
  Gene Symbol: ARG1
  Gene Name: arginase 1
  Uniprot ID: P05089
  ENST ID: ENST00000368087
  CDS Start-End: 140-1108
agtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagatta

SEQ ID NO: 108626 - DNA, 2045 bp, Homo sapiens
  Payload ID: 1340
  Gene Symbol: ARG2
  Gene Name: arginase 2
  Uniprot ID: P78540
  ENST ID: ENST00000261783
  CDS Start-End: 181-1245
gcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctacagtactatgtaaatttaaagaagtcataaacagcatttattaccttggtatatcatactggtcttgttgctgttgttccttcacatttaagtggtttttcatctttcctccctcctcccacagcctggctatacagtgcatccttgaactgtcagcccacagcagcaatatgcttattctatccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagggataacactgtctacctcacagaaatgttaaactgagacaataaaaaccaaagcataaaaatggattctgaaa

SEQ ID NO: 108627 - DNA, 361 bp, Homo sapiens
  Payload ID: 1341
  Gene Symbol: ARGLU1
  Gene Name: arginine and glutamate rich 1
  ENST ID: ENST00000360629
  CDS Start-End: 156-361
gaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgagga

SEQ ID NO: 108628 - DNA, 821 bp, Homo sapiens
  Payload ID: 1341
  Gene Symbol: ARGLU1
  Gene Name: arginine and glutamate rich 1
  ENST ID: ENST00000375926
  CDS Start-End: 225-653
gactccttagcagcggagcagcccacggcctgcctgtactgcctgttacatgggccctctggtttgatgtcatcagtggaaatagaagcagggaactgacattctgatttggcatttgcttcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttt

SEQ ID NO: 108629 - DNA, 3390 bp, Homo sapiens
  Payload ID: 1341
  Gene Symbol: ARGLU1
  Gene Name: arginine and glutamate rich 1
  Uniprot ID: Q9NWB6
  ENST ID: ENST00000400198
  CDS Start-End: 246-1067
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattccctttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaattttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaatttttttttttttcaatgtaactttttttggtgaagattcatggttcctaagttctgtattcaagtttttggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 108630 - DNA, 619 bp, Homo sapiens
  Payload ID: 1342
  Gene Symbol: AVP
  Gene Name: arginine vasopressin
  Uniprot ID: P01185
  ENST ID: ENST00000380293
  CDS Start-End: 51-545
acagagccaccaagcagtgctgcatacggggtccacctgtgtgcaccaggatgcctgacaccatgctgcccgcctgcttcctcggcctactggccttctcctccgcgtgctacttccagaactgcccgaggggcggcaagagggccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactgagccccgcgctcgccccaccggcgcgctcttcgcgcccgcccctgcagcacggacaataaacctccgccaatgca

SEQ ID NO: 108631 - DNA, 5963 bp, Homo sapiens
  Payload ID: 1343
  Gene Symbol: AVPR1A
  Gene Name: arginine vasopressin receptor 1A
  Uniprot ID: P37288
  ENST ID: ENST00000299178
  CDS Start-End: 107-1363
agaccctgcgcttcggacgaggagcccaagtcctccgagacggggagggagcggcccgcgagggctggagctccgaagagggccgagtaggagctgcatggacagcatgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttgagccttgcattcatgcaacttgattcttgtgattgactttttggctcattagctgaattgagctagaaatcacaagaacaaatacactttattaatataaccataaatcaattcattgtgtatgagactgtgtttctagttgcattttcatattgctaccaaaaactagacattattttgtatggaatattaatggaaacatgctgtactaaaatatgcaggtctgattcccagaaatacaacagaagttatatttttaaaggaaaaatcataaccaccctagctttatattttgttgttagtttcttttattttcatttctaacataagtaagacttgattggtttaaaagtcacataaaatgcggcactatttctgaacaaagagagctcatcatcagtcttaatattcagagaaaacttcagagaaattatgttttcatccattaaaattaatttgtgcatcagaaaatgcagccttaaacagtgtccaggagatgggatggtacctcctaggagtacaagtgcctggggtgtaatgagctcctgctcattgtggccagtttagagttctattagaagctatcaatcaccttgcatttcaaaatggtaactttacaactggcagtggcctccttttggttcctcacatattattggtcaagaaaagcatgaaaactgagatgctgaaggtgagaggaaatgttgactggccaaaaatatcttttttcccccactgcgaggttgttttaaagtcagatttgtataaggaaagccaaattttattaaaagagtagaaaaggattgcttaaggtactctggactttctcttggacattgtaaacgtattttgatcagtgttacaagggtatcctgtgctatgctggacattaacaagatcattatcttcatgtttggggaattcagattcataatatgagtatcctaaagagtgactcaggatataaagtgtcccaacatgtttaattaaaaatagctttgtctttccaatctctcactcatctaacaattgcaaagcagagatgagacagggttgggacatgggtgacagatggaaagagaactgctctgtgcccagactggcttccttcattattaaatccacaactttaggcaagtttcttaaacacatataaagcctctgtttccttgacttaccgtggggttgataacacttacctcacagggttgttgtaaggactaaatgaaatcaaatatgttaaaagagcttcagaaatagtaaagtactatacacatgctagcagttgcttttattatagccttgggatctccaaaattgcacagatgttttccagtttatttttcattaactagaattggttcatttcatggctgggatataaaatcctaaaatttaaatatagatcgctgattcattggacaacatttccagtgactgctcagcttgacttctcctgcctgactaaagttttccaatttaaagacagaacttgcttttctttgaatgcaggtagatcaaagccacccacaagcatcaattttttccatttttaaacggagaccaattacactactttgctgttattacatttttcattaatggaactcagtgatttttttcctagctattttgtctggctgcttcttcttcttagagatcatgcaatgatttgaggatacatcataaatattttgcatccttaagaggaagtaatagttgctttttttttttttgaaacagagtcttgctcttttgccaggctggagtgcagtggcgtgatctcggctcactgcaacctccgcttcctgggttcaagcgattctcctgcctcagcctcccgagtagctgggactatatgcatgtgccaccacacccagctaatttttatatttttagtagagatggggtttcaccatgttggccagcatggttttaatagtattattgagtttctttttttacctttgtagataagaaaatgagaactggatagcactgtgagaacccggaagcgataacttcactcctcttcattcttctgccttttgaaattctcagcccttaggctccttgtattgataggcctaaaaacatgtttccaaatgctttatagagattataaacctagggactccctaggttttcaaattcttctttctaaaaataacaaatatgtctcttaaagggtactgtccaatataagccataactaaattaattaattcattatttgagttagagtagcatctcagtaacccagcactcgaagactgtcagtccttttaacaactctttgatagttcaaaaactaaagctttttggtttggaactaagatgaacccatttttttctaaatccatttccaaagtaagaacctcagaacctatagatcttgcttcaaaatgttgatatgtacccccaagcaaaacaattcaatttgaatgttatttctgagaacagctcacaaaaaaaagtgcatatcaccctacccagttgtattttctccttttaaatgtattgggagatgagacagtagaaaatgggctggggaaacatgagatctgggtgctagttctgcactaggcaaatacatggtcttattctctgcggtttaggctgagaagtttcatctgtctggttgctaaattttctcaatgttatgtacccagaaatggacgccacatatctcaaaacaatatttcagattggaaggaatctacctgcctgtctgtttcagaagaagagaaactgaaaaagtattccgggaagggaagttttccttttcttgactaaagagaagacctgagatattatgccaaataacagcttacagtcaagaaaaaaatgtgttgcagcaccttattttatttttcacagttaacagtgggaagatcctgcaagtacacaattttaatgcctctatatgggtattaggaatgtgatatataaaaaatgtccagtagggagaaactaatcagttgggcatttgatgaatattaactgatgatggtaaataaacaatttagagtgcattattaagtgcttaatgggttaattttggagcatgtattctaaagtgtaaaactacttggcttttattttgaaatttcatttggaacacaattgtgaaggaaatcagtgaaattcttgggttaattatatacttgttttacatatagaatttctatcatcatcaaacaagtcttatgccatgatttcgggaagggtatggttttagagaaaaaaatactaagcagtcttaatgatacacaggaccctgccaagcttattacagtttctagaatggacaactactaatgattaagaaacaactttcatctgttattacacaagaaacccgattaggttaaagtttgatgttttcagactctaaagcctatgtttttgtaacttaattggactttcagagtgttaaattatggcttcagagtttggctctacctaaaatttagttagatgccaaccagggagaaattaaacctaatccttcaccccaaatatcagaggttagacaaacccatgttaattggagccttatggttattcatattggaggcaatagctttatttagaggaagcccaggacagggccgtctgggatgctagttctggaaatgcagaagcagccactgtatccctgcccaccccctccatccagcccttttggtactactcagtattgttgacaacatttggaatcataagtaacataggacagtaagtattagagaatgattctccgttagaattggacctcagccgatttgagccaaaatttaggaactattcagaagacagtttctttcttttgagtgcttaagacagtgtaaatggttcgaatcacacacattttaagattccattgtatacataagcattttaagaatattgttttaacataattattaggcatactaagttatcatgaatgaaaatgtacatgtgacctgtagtatgttatatattattatggctaaatgttaaatgccatttttttgctttttagttttatgtatttttgtatgtatatacccacatttttacattgatttatgttctaaataataattaaaacaaagtattataaaatgaatgaaatatttttgtgttccatggtcaaattattaataaattcaggaaagaaaatctgatgataaatctgatataaataccagaataattattattaatataaaataatattttcacatatgaaggtatgtcttcatactacaggatttctgacttgaatatattctataatgctttaattcattaccataacaaatgtactaagaattaatgttgcatctttagtattccattttttggaactgtttttcaaatgttctatatcctctagcttattatgctatctaaaataatttcagtgtgttttttcctggggcaactgaatgattcttgttttgaatgagtgataaaatgttttgtgatagtatctaatatttggtcctttacagaaaaaatggcttgtggtactatattgaaaaaactattgtatttcctcaattttactgtgtgttgtcttgtttctataaacaaaaataagttttgga

SEQ ID NO: 108632 - DNA, 691 bp, Homo sapiens
  Payload ID: 1343
  Gene Symbol: AVPR1A
  Gene Name: arginine vasopressin receptor 1A
  ENST ID: ENST00000550940
  CDS Start-End: 1-561
atgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacggtgaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacggataagaaaatgagaactggatagcactgtgagaacccggaagcgataacttcactcctcttcattcttctgccttttgaaattctcagcccttaggctccttgtattgataggcctaaaaacatgtttccaaatgctttatagagattataaa

SEQ ID NO: 108633 - DNA, 2237 bp, Homo sapiens
  Payload ID: 1344
  Gene Symbol: AVPR1B
  Gene Name: arginine vasopressin receptor 1B
  Uniprot ID: P47901
  ENST ID: ENST00000367126
  CDS Start-End: 466-1740
ggcttggctggggcttcctgccctgagcgcgacaccgactgccccggaccgcgcctccaagcaggctgaagggcttccgctcttggcttccagaaaagtttggagaaagagaatttgaggcggattggagggtggtagcccctccccagccttctttccctcccagaagcctcactctgcacagcgtcccccattcttcccgtcctgattccccatcttcctgacccctccttctccctctcctgggtcgatcccagtcacattttctccttccgaatctcatcctccctcctcctctctatcccagtcctctgaacgatttccgcctatttgcaagccttctccctgtcattctcaacgcttctcctttctctccacctcccctgccactccattttatccatcaaacctctccacttgcatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcgggcactggaaatgagagctgggagggtaagggttggagttagaggagccctgtctaaagcggagcgaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtctaggggtccacgggtggcaggaattcagaggctggccttgtgccctggctacctgtctccattctaacctgactggcacatctcagcctaaccaggagaggggagaagtgaaaaaccgtgaggaggactctatttggatcctggatttgttgttgttgttgttgttgttagagagaa

SEQ ID NO: 108634 - DNA, 1622 bp, Homo sapiens
  Payload ID: 1345
  Gene Symbol: AVPR2
  Gene Name: arginine vasopressin receptor 2
  Uniprot ID: P30518
  ENST ID: ENST00000337474
  CDS Start-End: 72-1187
cttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttcc

SEQ ID NO: 108635 - DNA, 1763 bp, Homo sapiens
  Payload ID: 1345
  Gene Symbol: AVPR2
  Gene Name: arginine vasopressin receptor 2
  Uniprot ID: P30518
  ENST ID: ENST00000358927
  CDS Start-End: 210-1325
ttcacgccaccgcccagctgcccaggagcccagccaggactggccatactgccaccgacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccaca

SEQ ID NO: 108636 - DNA, 1307 bp, Homo sapiens
  Payload ID: 1345
  Gene Symbol: AVPR2
  Gene Name: arginine vasopressin receptor 2
  Uniprot ID: P30518
  ENST ID: ENST00000370049
  CDS Start-End: 33-962
caggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcc

SEQ ID NO: 108637 - DNA, 1600 bp, Homo sapiens
  Payload ID: 1345
  Gene Symbol: AVPR2
  Gene Name: arginine vasopressin receptor 2
  ENST ID: ENST00000434679
  CDS Start-End: 535-681
ctgcccagccccatctttcttggcccccgaggggtggctgcccagggcctctctcctggcacagttccatgtagtgcctgcccatgtggctcccagttcctccccggggtcctggctgagcagaatggcactggatcctgatctggcttcttgcatcccagaggagaccgccatgcgggcccttcctccagattcttccctagtttaacaacaggaagcgaggagtccaggggggcagagattgccacgggcctggccacattgctaggggaggtcccaacctgctgctgagatccggcactgcacagcctcgttcaggcagagaaactgataaggagatggttgtctgctcaccccaaaaggactggccatactgccaccgacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccac

SEQ ID NO: 108638 - DNA, 1261 bp, Homo sapiens
  Payload ID: 1345
  Gene Symbol: AVPR2
  Gene Name: arginine vasopressin receptor 2
  ENST ID: ENST00000430697
  CDS Start-End: 146-1261
cacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacc

SEQ ID NO: 108639 - DNA, 1457 bp, Homo sapiens
  Payload ID: 1346
  Gene Symbol: AVPI1
  Gene Name: arginine vasopressin-induced 1
  Uniprot ID: Q5T686
  ENST ID: ENST00000370626
  CDS Start-End: 569-1012
tggacacgccccctccctgtctcccaccgatgattggcgcacggaactccgccttgggtttggaaggctcgcctgggagctcatacctggctagggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaa

SEQ ID NO: 108640 - DNA, 1727 bp, Homo sapiens
  Payload ID: 1347
  Gene Symbol: RSRC1
  Gene Name: arginine/serine-rich coiled-coil 1
  Uniprot ID: Q96IZ7
  ENST ID: ENST00000295930
  CDS Start-End: 163-1167
gatgcactcgatatctcggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatca

SEQ ID NO: 108641 - DNA, 1443 bp, Homo sapiens
  Payload ID: 1347
  Gene Symbol: RSRC1
  Gene Name: arginine/serine-rich coiled-coil 1
  Uniprot ID: Q96IZ7
  ENST ID: ENST00000312179
  CDS Start-End: 95-925
gagcttaaactgaagcaagttcggtggacgccggcggcgccctgatctaaagaaacgactcagggactgcggcgcttgcacgtcaacgggagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaagggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaa

SEQ ID NO: 108642 - DNA, 769 bp, Homo sapiens
  Payload ID: 1347
  Gene Symbol: RSRC1
  Gene Name: arginine/serine-rich coiled-coil 1
  ENST ID: ENST00000471994
  CDS Start-End: 159-769
cggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaa

SEQ ID NO: 108643 - DNA, 679 bp, Homo sapiens
  Payload ID: 1347
  Gene Symbol: RSRC1
  Gene Name: arginine/serine-rich coiled-coil 1
  ENST ID: ENST00000494002
  CDS Start-End: 186-679
tttgtctgtattgtgccggacagggcttgctgtgagaagtgtggctatgcaaatacatactcacaaaagaatatttacatatgatgttatatttaagtgtgtaaacaaatatacctctaagtgtggcttaggggacattttcaagtactctgaatattaatgcagactttctggaagttaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtgg

SEQ ID NO: 108644 - DNA, 1195 bp, Homo sapiens
  Payload ID: 1347
  Gene Symbol: RSRC1
  Gene Name: arginine/serine-rich coiled-coil 1
  ENST ID: ENST00000475278
  CDS Start-End: 94-945
agcttaaactgaagcaagttcggtggacgccggcggcgccctgatctaaagaaacgactcagggactgcggcgcttgcacgtcaacgggagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataa

SEQ ID NO: 108645 - DNA, 755 bp, Homo sapiens
  Payload ID: 1347
  Gene Symbol: RSRC1
  Gene Name: arginine/serine-rich coiled-coil 1
  ENST ID: ENST00000477788
  CDS Start-End: 1-338
aaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtatcctcctacctcaacctcctgggtagctgggactacaggtacacaccgccacacccaactatgatttttgtatttttggcggagatggggtttcaccatgttgcccaggctggtctcaaattcctgagctcaagcgatccccctgccttggcctcactaagtgcagggattacaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctggtaagtgttgataattaacttttattaaatgaagaagtgacga

SEQ ID NO: 108646 - DNA, 788 bp, Homo sapiens
  Payload ID: 1347
  Gene Symbol: RSRC1
  Gene Name: arginine/serine-rich coiled-coil 1
  ENST ID: ENST00000476899
  CDS Start-End: 206-788
ggctccggactccttgggtcaaggctggtggctgtagggtgggtgggtggccgcaggcctcaagcttggccttctgtcttgaggacatgtcggagagttcgccgactcctcccctcgccccacgttcctggttcttcatagctgcttttgggtttcctggctcatcttgcaatataagcctggcgcttcctcactagctctagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctg

SEQ ID NO: 108647 - DNA, 2411 bp, Homo sapiens
  Payload ID: 1347
  Gene Symbol: RSRC1
  Gene Name: arginine/serine-rich coiled-coil 1
  Uniprot ID: Q96IZ7
  ENST ID: ENST00000464171
  CDS Start-End: 126-956
agaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaagggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggacttttaggccttgctttacaaaactggtttttaacagctgacatgaatatttcccgtttctattttcttttttttttttttttttttttttttgagacggagtctcgctctatcccccatgctggagtgcagtggcgcgatctcagctcactgcaagctccgcctcccaggttcacgccattttcttgcctcagcctcccgagtagctgggactacaggcacccgctaacatgcccagctaattttttgtgtttttagtagagatggggtttcaccattttagccaggatggtctattttcttctgttgtccagtcactaatttagtctctgcgaagactgtagctcagaacaaaagataagcaaaaaaagtcttcagggtaggactgccaacatataggacattttaatgccatcttctttatatttctgggacattaaaattcaaatctctgttgaaaatgaaaaatgtaaaacttagttgcaaacagtatagaaaataagtgatgatgaaatatttgttttcatacaaacatgctttcccattctaaatagatgctagttttcttttttccttggctgtaaataaaagtgccccaaatgaa

SEQ ID NO: 108648 - DNA, 1335 bp, Homo sapiens
  Payload ID: 1347
  Gene Symbol: RSRC1
  Gene Name: arginine/serine-rich coiled-coil 1
  ENST ID: ENST00000480119
  CDS Start-End: 86-685
gtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggatttcaccaaaagaattgtgagaggaaaaagaaacttacatctaacaggaagagaaaagttttaggaagaccaaattggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaat

SEQ ID NO: 108649 - DNA, 1410 bp, Homo sapiens
  Payload ID: 1347
  Gene Symbol: RSRC1
  Gene Name: arginine/serine-rich coiled-coil 1
  Uniprot ID: Q96IZ7
  ENST ID: ENST00000480820
  CDS Start-End: 159-1163
cggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaa

SEQ ID NO: 108650 - DNA, 792 bp, Homo sapiens
  Payload ID: 1347
  Gene Symbol: RSRC1
  Gene Name: arginine/serine-rich coiled-coil 1
  ENST ID: ENST00000482822
  CDS Start-End: 1-625
gtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatgtaatatccttaaactttacgaatgtcagttgaagtctaatttactgaaattatttcaatctgttatccttttgtgctaacaccaaggagaccattggaggaaacaggttcatattcccttgctaaaaataggcatctggcccccaggcctttagaactgttatctatatttgaatacagtagggtccaactcatgttgc

SEQ ID NO: 108651 - DNA, 1738 bp, Homo sapiens
  Payload ID: 1347
  Gene Symbol: RSRC1
  Gene Name: arginine/serine-rich coiled-coil 1
  Uniprot ID: Q96IZ7
  ENST ID: ENST00000611884
  CDS Start-End: 175-1179
gatgcactcgatatctcggctgaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatc

SEQ ID NO: 108652 - DNA, 3520 bp, Homo sapiens
  Payload ID: 1348
  Gene Symbol: RSRC2
  Gene Name: arginine/serine-rich coiled-coil 2
  Uniprot ID: Q7L4I2
  ENST ID: ENST00000331738
  CDS Start-End: 147-1451
agctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagatagattaatgcattaaagggatgtaagcacttttattttaataaagtgccttataacaagttctttgcatgctttttgctcattatccctttgaagtcttctccagcatagactataaaatattaaaatattagaaattttttttgtttgtttttttgagacaggatcttgctctgttgcctaaactgggtgcagtggcacaatctcggctcactgccagagcctctgccccccaggttcaagcaattctcccacctccacctcccatgtaactgggattacaggcgtaccaccgcacccagctaatttttgtatttttagtagaggtggggttttaccatgttggccaggctggtcctgaactcctgacctcaggtgatccaccctcctcagcctcccaaagtgccgggattataggcgtgagccactgcagccagcctagaaaatgttttgttactagattgaacataaatctggagccaaggggtggggggggcctgcaaaacttgaagttaatttacttcagttacagcaaagtaataaggtttggctttcctttgaaaaatcctttggaaaacatcacagaatgagagcacattacaatcagggaagactacaggaataagattgacagccttattttaaaagctggaattaagtcttgccaacttgctcattaggtattttttttatacatgaaaatgaagtaatggggtgttttctttttttttgctttctgtcctaggctggagtgcagtgcattgcagcaggctcccccaggctcaagcagtcctcccacctcagcctcttgagtacctgggaccacaggtgctcaccaacacacctagcttgtttttaattttttataaagacaaggtcttgttacgttgcccaggttggtcttgaattcctggcctcaagcaatcctcccacctcagggctcccaaagtgatggggttacaggtgtgatccacttcacctagccagattgtaagatttttaatgtactttaataaacctttcattttcccagagcacagaaattctatggcaaaatggcttttcaccgtgtttcagtgacaaatctaagccttctaaggaaatgacactatggatccttcatttcgtgatcatcaacatttttcaattaagctctgcctttttaaatcaatcttattaaaaatgttcatgaccttctaaggcagtgtggacgcaaaagcttcctgtgtgtctacagttattttaggagctgaccatacatgatgagtgatacagcctgtactttgctcatctagagcagcactgtccaataaaatatgtgtgtata

SEQ ID NO: 108653 - DNA, 936 bp, Homo sapiens
  Payload ID: 1348
  Gene Symbol: RSRC2
  Gene Name: arginine/serine-rich coiled-coil 2
  ENST ID: ENST00000344591
  CDS Start-End: 228-936
ccgggtctctcgcgcgagcgatttagtctgaggcgaagcttcggagcggccggtactgttgaaagcgacaagtggaggcgccgctctagcggccgggactctgaactatggcgataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatgg

SEQ ID NO: 108654 - DNA, 1956 bp, Homo sapiens
  Payload ID: 1348
  Gene Symbol: RSRC2
  Gene Name: arginine/serine-rich coiled-coil 2
  ENST ID: ENST00000433877
  CDS Start-End: 84-314
agtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctc

SEQ ID NO: 108655 - DNA, 1041 bp, Homo sapiens
  Payload ID: 1348
  Gene Symbol: RSRC2
  Gene Name: arginine/serine-rich coiled-coil 2
  ENST ID: ENST00000527399
  CDS Start-End: 143-373
gtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggaagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgc

SEQ ID NO: 108656 - DNA, 2001 bp, Homo sapiens
  Payload ID: 1348
  Gene Symbol: RSRC2
  Gene Name: arginine/serine-rich coiled-coil 2
  ENST ID: ENST00000532695
  CDS Start-End: 148-378
aagctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctc

SEQ ID NO: 108657 - DNA, 792 bp, Homo sapiens
  Payload ID: 1348
  Gene Symbol: RSRC2
  Gene Name: arginine/serine-rich coiled-coil 2
  ENST ID: ENST00000528263
  CDS Start-End: 1-530
gaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaagacaaaatacctgaaacaagaagacggggtctccctatgttgcccaggctggtaacacagtgtaacctgatgtgcttccctgggaacccagcctgacagaaactgcagctgaacagcagcaaaagtgttggaaagggcaaagaaattacaagaacagcgagaaaaggaaatggttgaaaaacaaaaacaacaagaaatagctgcagctgcagctactggaggttctgttctcaatgttgctgccctgttggcatcaggaacacaagtaacacctca

SEQ ID NO: 108658 - DNA, 562 bp, Homo sapiens
  Payload ID: 1348
  Gene Symbol: RSRC2
  Gene Name: arginine/serine-rich coiled-coil 2
  ENST ID: ENST00000528279
  CDS Start-End: 486-562
atttagtctgaggcgaagcttcggagcggccggtactgttgaaagcgacaagtggaggcgccgctctagcggccgggactctgaactatggcggaaggtattgctgaaagggagtgaaaattcaacttaaaaggttgtggaactaccaattctgactgatgcgcggtttccgaagtggcccgtgatgtaatcaatttgaagtccgagaagcgttacacccagagcacatgtgaggagaggcagaccatattttgcagcagcactgtgccaaggggctgttttcattaaagagggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgct

SEQ ID NO: 108659 - DNA, 545 bp, Homo sapiens
  Payload ID: 1348
  Gene Symbol: RSRC2
  Gene Name: arginine/serine-rich coiled-coil 2
  ENST ID: ENST00000526560
  CDS Start-End: 272-545
atccgggtctctcgcgcgagcgatttagtctgaggcgaagcttcggagcggccggtactgttgaaagcgacaagtggaggcgccgctctagcggccgggactctgaactatggcgataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggag

SEQ ID NO: 108660 - DNA, 1502 bp, Homo sapiens
  Payload ID: 1349
  Gene Symbol: RSRP1
  Gene Name: arginine/serine-rich protein 1
  Uniprot ID: Q9BUV0
  ENST ID: ENST00000243189
  CDS Start-End: 278-1150
atctctgcgcatgcgccgggggccagcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcttagtctttattgta

SEQ ID NO: 108661 - DNA, 1954 bp, Homo sapiens
  Payload ID: 1349
  Gene Symbol: RSRP1
  Gene Name: arginine/serine-rich protein 1
  Uniprot ID: Q9BUV0
  ENST ID: ENST00000431849
  CDS Start-End: 205-933
tccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggctt

SEQ ID NO: 108662 - DNA, 824 bp, Homo sapiens
  Payload ID: 1349
  Gene Symbol: RSRP1
  Gene Name: arginine/serine-rich protein 1
  ENST ID: ENST00000566395
  CDS Start-End: 1-253
tcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatgaatgtggtctgcagacattgatgaagaaaatctgttgctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttca

SEQ ID NO: 108663 - DNA, 629 bp, Homo sapiens
  Payload ID: 1349
  Gene Symbol: RSRP1
  Gene Name: arginine/serine-rich protein 1
  ENST ID: ENST00000568701
  CDS Start-End: 243-629
gtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagg

SEQ ID NO: 108664 - DNA, 772 bp, Homo sapiens
  Payload ID: 1349
  Gene Symbol: RSRP1
  Gene Name: arginine/serine-rich protein 1
  ENST ID: ENST00000565733
  CDS Start-End: 1-550
ttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttca

SEQ ID NO: 108665 - DNA, 477 bp, Homo sapiens
  Payload ID: 1349
  Gene Symbol: RSRP1
  Gene Name: arginine/serine-rich protein 1
  ENST ID: ENST00000561867
  CDS Start-End: 190-477
gtccgttggccttcgtacccgtcttgagtgaggtgacgagtgttttctagtactggggtcggccgcgcagccctctcaggggtgggtggcaggaagagtgccgggtcccgcgtggtgcaaaaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagagg

SEQ ID NO: 108666 - DNA, 2013 bp, Homo sapiens
  Payload ID: 1349
  Gene Symbol: RSRP1
  Gene Name: arginine/serine-rich protein 1
  ENST ID: ENST00000568254
  CDS Start-End: 216-896
ctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttca

SEQ ID NO: 108667 - DNA, 3034 bp, Homo sapiens
  Payload ID: 1349
  Gene Symbol: RSRP1
  Gene Name: arginine/serine-rich protein 1
  Uniprot ID: Q9BUV0
  ENST ID: ENST00000473314
  CDS Start-End: 1193-1873
ggagtacgccatttgagagtaggcgtgagaagttgctctgtgtgctgagcgttctaaaggaaggcgtccgttggccttcgtacccgtcttgagtgaggtgacgagtgttttctagtactggggtcggccgcgcagccctctcaggggtgggtggcaggaagagtgccgggtcccgcgtggtgcaaaaggtgggttcaggtttgcggccacacagcgctactcaggactttttagtcttgtttattttctccgtgcctgttcccgccccccgcagctccacctctgggagaggggcgggttcagctccaggaggcggggacttcccggcttggcgtggctggggtgtcccgtggaccccagtctcggcgcggtgacccacttatgggacttggcctttctttgttgtttgtttaaggcagggtttctcagcctgggcactactgaggttttgggccggctaattctgtctgggttggggagggtgctgtcccgtgcttcgcaggttgtgtagctgcatcccccgcctctacccagtggatgcaagtagcagccccagtgaaccaaaaatgcccccagactttgccaaatatcccctcccggggaagatcgcctcgcttgagaaccactgttggaggagagcctgggttttcgggaggtaaccgtttacaaaggggagaacggtaagaagccggaagcaacgatgacttagctacgtgaaagacttgcggccgggctcgcccctcttctagaagccgtcagtttgggtctcgcgtctggaatcaccgtcaaggagtcagatccagccccggagagggagcagggtcgaggtctccttgcagaaggcgccaccgcaggaagcacaggcgcaacgtgcggtctccctagcggaggcgctcgcgatcctgcagccgccggtccgggaggtgctcggtagccctccttggtgcctgtccggtagctggtcactctcgggggaaggtcgtgtgcagaagggcacatgcgatcacacagagacggcgttgctgcggctttgacccgatggtgcacccgaaagaacacagagggtgaagggagagatccaggaagtggtcgcggagcagaaccccccttcacttcagttaaaaaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatgaatgtggtctgcagacattgatgaagaaaatctgttgatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttc

SEQ ID NO: 108668 - DNA, 480 bp, Homo sapiens
  Payload ID: 1349
  Gene Symbol: RSRP1
  Gene Name: arginine/serine-rich protein 1
  ENST ID: ENST00000568996
  CDS Start-End: 212-480
gctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgagtgaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcag

SEQ ID NO: 108669 - DNA, 992 bp, Homo sapiens
  Payload ID: 1350
  Gene Symbol: ARGFX
  Gene Name: arginine-fifty homeobox
  Uniprot ID: A6NJG6
  ENST ID: ENST00000334384
  CDS Start-End: 11-958
ttcagaaaccatgaggaacagaatggccccagagaatccccagccagaccctttcatcaataggaattattccaacatgaaggtgataccaccacaggatccagctagtcccagtttcactctgttatccaagctggagtgcagtggcacggtctcggcttactgcagcctcaacctcccaggttcaactgatcctcccacctcagcctcccgagtagctgcgactacagcaatacggagaaggcataaagaacgtacttctttcacccaccaacagtatgaggagctagaagctctgtttagccagaccatgttcccagatagaaatcttcaggagaaactagctttgagactcgacctaccggagtcaacagtaaaggtttggttcaggaaccggcgattcaaattgaagaagcagcagcagcagcaatcagcaaagcaacgaaaccagatccttccatccaagaagaatgtgcccacctcccccagaacatcccccagtccttatgctttttctcctgtgatttcagatttctacagctcccttccatctcagcccttagacccttccaattgggcatggaactctaccttcactgagagttctaccagtgacttccaaatgcaagatactcagtgggagaggctggtggcctcggttcctgctttgtactctgatgcctatgacatattccaaatcatagaactgtacaatcttcctgatgagaatgagatatccagctcttctttccactgtctgtatcagtatctctcacccacaaagtaccaggtaggaggacagggttcctctctcagcatctttgctggtccagctgtaggcctatctcctgcacaaacctggcccaatatgacaagccaagcctttgaagcctacagtctaacagatagcctggaattccagaaaacctccaatatggtagacttgggatttctctgaccagagtactaataaatatagatcatttagaaaa

SEQ ID NO: 108670 - DNA, 8026 bp, Homo sapiens
  Payload ID: 1351
  Gene Symbol: RERE
  Gene Name: arginine-glutamic acid dipeptide (RE) repeats
  Uniprot ID: Q9P2R6
  ENST ID: ENST00000337907
  CDS Start-End: 636-5336
aaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaacccttgg

SEQ ID NO: 108671 - DNA, 6733 bp, Homo sapiens
  Payload ID: 1351
  Gene Symbol: RERE
  Gene Name: arginine-glutamic acid dipeptide (RE) repeats
  ENST ID: ENST00000377464
  CDS Start-End: 156-4052
ggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactac

SEQ ID NO: 108672 - DNA, 2973 bp, Homo sapiens
  Payload ID: 1351
  Gene Symbol: RERE
  Gene Name: arginine-glutamic acid dipeptide (RE) repeats
  ENST ID: ENST00000400907
  CDS Start-End: 75-1829
tgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccagcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgc

SEQ ID NO: 108673 - DNA, 5790 bp, Homo sapiens
  Payload ID: 1351
  Gene Symbol: RERE
  Gene Name: arginine-glutamic acid dipeptide (RE) repeats
  Uniprot ID: Q9P2R6
  ENST ID: ENST00000400908
  CDS Start-End: 629-5329
cacagacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaa

SEQ ID NO: 108674 - DNA, 4598 bp, Homo sapiens
  Payload ID: 1351
  Gene Symbol: RERE
  Gene Name: arginine-glutamic acid dipeptide (RE) repeats
  Uniprot ID: Q9P2R6
  ENST ID: ENST00000476556
  CDS Start-End: 566-3604
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagat

SEQ ID NO: 108675 - DNA, 273 bp, Homo sapiens
  Payload ID: 1351
  Gene Symbol: RERE
  Gene Name: arginine-glutamic acid dipeptide (RE) repeats
  ENST ID: ENST00000514428
  CDS Start-End: 1-273
actgtgtgtatatcgagagtcggaggccaaacacaccgtatttcatctgtagcattcaagacttcaaactgagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgccctta

SEQ ID NO: 108676 - DNA, 533 bp, Homo sapiens
  Payload ID: 1351
  Gene Symbol: RERE
  Gene Name: arginine-glutamic acid dipeptide (RE) repeats
  ENST ID: ENST00000505225
  CDS Start-End: 1-533
atgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgc

SEQ ID NO: 108677 - DNA, 743 bp, Homo sapiens
  Payload ID: 1351
  Gene Symbol: RERE
  Gene Name: arginine-glutamic acid dipeptide (RE) repeats
  ENST ID: ENST00000464972
  CDS Start-End: 477-743
cgtggagagacagtgtgtggatgagggagggtcacagcacatgctcagtcctgtcagagtgaggggaagtttctgcgttctgcgtgaaggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcagtctagagggcaagacagccattcaaagaaataactacaaaaaataaatataaaatcctgactgtgatatgggtggaaggagaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaaggga

SEQ ID NO: 108678 - DNA, 962 bp, Homo sapiens
  Payload ID: 1351
  Gene Symbol: RERE
  Gene Name: arginine-glutamic acid dipeptide (RE) repeats
  ENST ID: ENST00000488215
  CDS Start-End: 885-962
tggattaagcggcaggaattctgattactgaggtggagtgtgccagtagttgaggtcctcatctcatacctgaactgtgtcagcagcctctttaactggtctgtccctaatctacacttaggccacactgccactggcacagtcctcatccagtcttttcatggaaagctccagcttcagcctttctgccagcctacaattaggaactcttccgtgcggcctgaagggctctctgcaaccggatccttgcctgcctctttcgtcttatctgctggcactccattctgcacaccctgtcctccttgcagttcccagaatgttccctgtgccttttcctggctgacttctgctggaagccctgctggagcccacctggcaggctcacactcttccttgtcacttcctctaagacatcagcaagcagaaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcg

SEQ ID NO: 108679 - DNA, 639 bp, Homo sapiens
  Payload ID: 1351
  Gene Symbol: RERE
  Gene Name: arginine-glutamic acid dipeptide (RE) repeats
  ENST ID: ENST00000464367
  CDS Start-End: 1-639
tggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcggtgagtcccctggggccatggggctcctggcaacttcttcagtttcctgggatgtgtgggggcttgagcctcccagggggaggaagcgaaagtcttgtttaccagacaaagtcctggaggggagctgctttgcccgaggcggtagcttgcctgtgggctgggaagagttctctgttctctccttcgaggggccccagggtggcatcctgctctgggttttgtagcaagctcttagcttctggctcagtgcaggctctccaaggcccctcttgctctccaaggctgctgcttgtggtgtcacttccattgtatcaaatctctgctattttaaacttgcaggctcttt

SEQ ID NO: 108680 - DNA, 414 bp, Homo sapiens
  Payload ID: 1351
  Gene Symbol: RERE
  Gene Name: arginine-glutamic acid dipeptide (RE) repeats
  ENST ID: ENST00000468247
  CDS Start-End: 310-414
cggccgctcaggcctccttttgttttagcaagtgcacttcactccccgggcccccacctgcccgcctgcgccgcccctttccgcgggtccggagttggcggggccctgcgccggaggaggaggaccaggcccgcgggctcagctctcgccgccagcgggccgcagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattca

SEQ ID NO: 108681 - DNA, 2143 bp, Homo sapiens
  Payload ID: 1352
  Gene Symbol: ASL
  Gene Name: argininosuccinate lyase
  Uniprot ID: P04424
  ENST ID: ENST00000304874
  CDS Start-End: 103-1497
ccggccagaaaagccctggccagtggcgggcgcgacactatccgtgcggccaggcggagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataaatggaagcggagaaaactgggcaagggcaatgagagtcgtagacgggaagggaagagggggctcccatcatagcctctgctctgtccaggccccatccccttcagacagggtatcacagtgacctcctaggccaggagcgatggctcacgcctgtaatcctagcattttgggaggcctgggcaacaggaagactccaactaccatattaaaaaaaa

SEQ ID NO: 108682 - DNA, 928 bp, Homo sapiens
  Payload ID: 1352
  Gene Symbol: ASL
  Gene Name: argininosuccinate lyase
  ENST ID: ENST00000362000
  CDS Start-End: 203-928
gcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggtg

SEQ ID NO: 108683 - DNA, 1765 bp, Homo sapiens
  Payload ID: 1352
  Gene Symbol: ASL
  Gene Name: argininosuccinate lyase
  Uniprot ID: P04424
  ENST ID: ENST00000380839
  CDS Start-End: 217-1533
cggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagaccccc

SEQ ID NO: 108684 - DNA, 1538 bp, Homo sapiens
  Payload ID: 1352
  Gene Symbol: ASL
  Gene Name: argininosuccinate lyase
  Uniprot ID: P04424
  ENST ID: ENST00000395331
  CDS Start-End: 199-1533
gacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcgggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcct

SEQ ID NO: 108685 - DNA, 1622 bp, Homo sapiens
  Payload ID: 1352
  Gene Symbol: ASL
  Gene Name: argininosuccinate lyase
  Uniprot ID: P04424
  ENST ID: ENST00000395332
  CDS Start-End: 209-1603
ggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgcccc

SEQ ID NO: 108686 - DNA, 1564 bp, Homo sapiens
  Payload ID: 1353
  Gene Symbol: ASS1
  Gene Name: argininosuccinate synthase 1
  Uniprot ID: P00966
  ENST ID: ENST00000352480
  CDS Start-End: 73-1311
gcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttcta

SEQ ID NO: 108687 - DNA, 1548 bp, Homo sapiens
  Payload ID: 1353
  Gene Symbol: ASS1
  Gene Name: argininosuccinate synthase 1
  Uniprot ID: P00966
  ENST ID: ENST00000372393
  CDS Start-End: 76-1314
cgagcccgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagaga

SEQ ID NO: 108688 - DNA, 1973 bp, Homo sapiens
  Payload ID: 1353
  Gene Symbol: ASS1
  Gene Name: argininosuccinate synthase 1
  Uniprot ID: P00966
  ENST ID: ENST00000372394
  CDS Start-End: 482-1720
ctgctctgccgcctgccaccgctgcccgagcccggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttcta

SEQ ID NO: 108689 - DNA, 807 bp, Homo sapiens
  Payload ID: 1353
  Gene Symbol: ASS1
  Gene Name: argininosuccinate synthase 1
  ENST ID: ENST00000422569
  CDS Start-End: 213-807
cccggtaaggagccctcggcccctctcgctgcccactccctagccgagagcacccgcttcccgggcccagaggaggaggcgtagaagacgcccgccccggggcccgcggaggcagagggcggaccccgatcgccactcgccggggactgggaccgaggcaggagggaaggggctcccgatgctcaaacgcctggcaccggattccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaacccca

SEQ ID NO: 108690 - DNA, 545 bp, Homo sapiens
  Payload ID: 1353
  Gene Symbol: ASS1
  Gene Name: argininosuccinate synthase 1
  ENST ID: ENST00000443588
  CDS Start-End: 7-545
gacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaa

SEQ ID NO: 108691 - DNA, 2427 bp, Homo sapiens
  Payload ID: 1354
  Gene Symbol: RNPEP
  Gene Name: arginyl aminopeptidase (aminopeptidase B)
  Uniprot ID: Q9H4A4
  ENST ID: ENST00000295640
  CDS Start-End: 44-1996
cctcgggttcgcggcccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagtta

SEQ ID NO: 108692 - DNA, 2282 bp, Homo sapiens
  Payload ID: 1354
  Gene Symbol: RNPEP
  Gene Name: arginyl aminopeptidase (aminopeptidase B)
  ENST ID: ENST00000367286
  CDS Start-End: 16-1851
aacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagtta

SEQ ID NO: 108693 - DNA, 1166 bp, Homo sapiens
  Payload ID: 1354
  Gene Symbol: RNPEP
  Gene Name: arginyl aminopeptidase (aminopeptidase B)
  ENST ID: ENST00000447312
  CDS Start-End: 134-1166
gccactgggcggtgcatccttcaccctttccgtccttccgcgtctcctccctggccctggaggcttgtccagattgcgccgcattcccgctcatcgcacactgccgtttctaacattttccgtggctttctagatgacctgttgttcatgcacttcacttagtgccctcttggacttttgggccgaggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccag

SEQ ID NO: 108694 - DNA, 505 bp, Homo sapiens
  Payload ID: 1354
  Gene Symbol: RNPEP
  Gene Name: arginyl aminopeptidase (aminopeptidase B)
  ENST ID: ENST00000449524
  CDS Start-End: 1-505
ctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgttgacccggacgacacctataatgagaccccctacgagaaaggtttctgctttgtttcatacctggcccacttggtgggtgatcaggatcagtttgacagttttctcaaggcctatgtgcatgaattcaaattccgaagcatcttagccgatgactttctggacttctacttgg

SEQ ID NO: 108695 - DNA, 851 bp, Homo sapiens
  Payload ID: 1354
  Gene Symbol: RNPEP
  Gene Name: arginyl aminopeptidase (aminopeptidase B)
  ENST ID: ENST00000487116
  CDS Start-End: 1-516
ttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttg

SEQ ID NO: 108696 - DNA, 780 bp, Homo sapiens
  Payload ID: 1354
  Gene Symbol: RNPEP
  Gene Name: arginyl aminopeptidase (aminopeptidase B)
  ENST ID: ENST00000492587
  CDS Start-End: 1-454
gcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggagccgggtgtgggctgagccctgcctgattgatgctgccaaggaggagtacaacggggtgatagaagaatttttggcaacaggagagaagctttttggaccttatgtttggggaaggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtttcatacctggcccacttggtgggtgatcaggatcagtttgacagttttctcaag

SEQ ID NO: 108697 - DNA, 5558 bp, Homo sapiens
  Payload ID: 1355
  Gene Symbol: RNPEPL1
  Gene Name: arginyl aminopeptidase (aminopeptidase B)-like 1
  Uniprot ID: Q9HAU8
  ENST ID: ENST00000270357
  CDS Start-End: 594-2078
ccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgacgcgcacccggctctgcgcctgcactcagccgccttccgtcgcgcccccgccgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgatctcctgcgctctttctcgcgactcttgtcctctgcatcttcctggctgtgtagggtgggctggcctgccgggacttggggcctggagctggtcaggagctgggtgtggccccctcctctgatacataagcccgagagcaggctccccgaatcctgcccagccccttggctggaccccctgggcctgagtagcctctggatgtcacaggaaagccatgtgtcaccttcactctgggccttcacctgtggcttaagccaaatcccggcctcagtggtgatcctttcccaagatgggtacaaggtgacaggcatgttttgttttggagaactgagatttccattttcccaggcgataggtgtcgctgcccttcacagtccccaaggatgtggcgccaccatctcagtgccacgcacacctggccaacatgccgtggcccagaagcagcacgtctcttctcccaacccgctggccaggcccagtcacagccccactccacacatggcagccaggaagtggggagggcaggaggtgctgggcaaataaccctgataccatcactgtccagtccccagtcaccaaatgtcccactcaccctccttcctgttctggatgccccgcccctcccctcccctcccaaggacatatgagtcccctccagtggcggtggcaactctggtctagggtctggggccgtctctacatgtgttgcttcatgtaccttcttcacatcaggtctgggggaggcgccaccccatccagagacctaggaactagaagactgccactgcccctcacacccagggataggatgactgcagtaacccctgtgaaagcgggtatggagggcacctggcagcccctgctgcatggccatctaaagtcttgccaggcaggcacagctagggcccctgcctgggagtggacaccccactcccccaagtcatgttctctgtggcctggggctccagccttgggaggacccctttcctgtttcttaaccatgcttgatggtgtcctcaaaggagccctgctcagtggcagaactgctttctcagcctcttccccgccaaggttgttttcaagtcccagcagtcacagactttcatcctgggctcttctttcttttgcaattcagctctcgaaatgactctgtggtctgcgggtgactccactccacgtgcctacagccacgcccacagcgccacctccggacgctgctgagctgcgcacctgtgcctgacacctggctttgggaaactcagcagcagtgcccagcgtcatgaccctgggggcaggagggcatctggatccaggatggcaccctcaccacaatctgtcttggctctgtgcccgcccgtggggtacacaggagggctctttcagccctaagtccttgtgttcctgacctttgttcctcttccacccagcttgcaagtgcagaatttttttttagctcgtcgcttccctgcagtcccttgtccaatgcagcctccggccgatactcaggccagtgttgtttcccaacctctccactagatacgcacacttagctcacggtctgcctcatgagtcatcccagttgagctttaccaaatgttttgccccacctaacagcctgcccacattccaaatcctggcaggtcgcacgttttattagcacagcacccctctcctagcggccagcttctctattaggccacgttatgctccagccacacaactatgaagcgcagacgtctcacacaacaaagctttctcatgctgcaggcccacctcaggctggcaggggaaggggggattctcttcaatgtgaccactctcggacccgtaccgatgaacagagatctcaaatgtttccaggcaccttgccagggataagagagctgttgaggggctcacactggcagtggaagttctaaggggcctacaaccacaggggctgcaaccccaccatatgcacaaaagcgggggcagatggcaaacagcactaatgacaacgacggagctgaggccagaatgtgagagagatctgcattttggggattagggcctagtcaggcaggtaggagatgatgttcaaaaagggaaaagaagcgtgatgaaagactggtttctacagagatagattagaaagctgaagcctgaaaaaacagtgaaggagacccatgcaaatttctaggccctggaggtccaaataaggttttctaagtccctcaggccatgacaggttcagtccagacttgtctcccagagtgtttctctgccatccctactctaactgggacttattggtggtgtttctctcctaaggccagatgctttgcacagaacattaggaaactccagatgtaaaggtaaggcacaactgagaatcacctgcccagggcagcaacacagtgtgaaggaaaacaggccactcaacccaaacttacacctgagacagaggcaacagaaaaatcagaaaaggactttagaacacatataatcaaaatctcagacctaaagacgacttttgaaataaaccataacatatgaagaggcacttatgaaacaagaacaggtagtttataaaaaagaaccagtcagagaccctggaaattttttaaaaagcaattactaaaataaaaaatgaaaactca

SEQ ID NO: 108698 - DNA, 1576 bp, Homo sapiens
  Payload ID: 1355
  Gene Symbol: RNPEPL1
  Gene Name: arginyl aminopeptidase (aminopeptidase B)-like 1
  ENST ID: ENST00000437406
  CDS Start-End: 1-744
gcctatgtggagaagtacaagttcaccagcgtggtggcccaggacctgctggactccttcctgagcttcttcccggagctgaaggagcagagcgtggactgccgggcaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgc

SEQ ID NO: 108699 - DNA, 538 bp, Homo sapiens
  Payload ID: 1355
  Gene Symbol: RNPEPL1
  Gene Name: arginyl aminopeptidase (aminopeptidase B)-like 1
  ENST ID: ENST00000451363
  CDS Start-End: 195-538
atcacaagctggtgcccagggcagtccccatctctgtggagggcttgcctgccgctggcctctctagataagctcctcatgactcatgcaaccttttcatcaacccggaaggaagcagccgccggtcgccactagtgggtgctgccttcacctgcctggagactgccttccgcctggacgccctgcaccggcagatgaagcttctgggagaggacagcccggtcagcaaactgcaggcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactctt

SEQ ID NO: 108700 - DNA, 4930 bp, Homo sapiens
  Payload ID: 1356
  Gene Symbol: ATE1
  Gene Name: arginyltransferase 1
  Uniprot ID: O95260
  ENST ID: ENST00000224652
  CDS Start-End: 115-1671
ggcttcgcgcgagcctcgggaggctcccgggcggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgcagtg

SEQ ID NO: 108701 - DNA, 4803 bp, Homo sapiens
  Payload ID: 1356
  Gene Symbol: ATE1
  Gene Name: arginyltransferase 1
  ENST ID: ENST00000369040
  CDS Start-End: 276-1544
ggcttcgcgcgagcctcgggaggctcccgggcggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgcagtg

SEQ ID NO: 108702 - DNA, 4900 bp, Homo sapiens
  Payload ID: 1356
  Gene Symbol: ATE1
  Gene Name: arginyltransferase 1
  Uniprot ID: O95260
  ENST ID: ENST00000369043
  CDS Start-End: 88-1644
cgggcggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 108703 - DNA, 2031 bp, Homo sapiens
  Payload ID: 1356
  Gene Symbol: ATE1
  Gene Name: arginyltransferase 1
  ENST ID: ENST00000423243
  CDS Start-End: 1-1546
ggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctg

SEQ ID NO: 108704 - DNA, 697 bp, Homo sapiens
  Payload ID: 1356
  Gene Symbol: ATE1
  Gene Name: arginyltransferase 1
  ENST ID: ENST00000455628
  CDS Start-End: 32-697
tggtcggcccgagcggaccctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaactt

SEQ ID NO: 108705 - DNA, 5165 bp, Homo sapiens
  Payload ID: 1356
  Gene Symbol: ATE1
  Gene Name: arginyltransferase 1
  ENST ID: ENST00000540606
  CDS Start-End: 371-1906
acctgcttgtgttcttgtattcagggcactggagtgcgtgccagctggtctggaagcagctccagcaagtcacttacacggtggccaggggcggcctgactttcaatccgagacccgccgggaatgactttgggataatcacaacctccggtcctcagtttccttacctgtgaaatggggctgataacgcacagctgtgggaagcaccggcccaaacgcagggcttggggacacgaccaccatccccgcccacgggtccccgcgccaggcttcgctctccacccctcccgccgcgggccccagcgcttcgccgaggtcggccccgggcgccaagaggcgtggtcggcccgagcggaccctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgcagtg

SEQ ID NO: 108706 - DNA, 4826 bp, Homo sapiens
  Payload ID: 1356
  Gene Symbol: ATE1
  Gene Name: arginyltransferase 1
  ENST ID: ENST00000543447
  CDS Start-End: 356-1567
ggcttcgcgcgagcctcgggaggctcccgggcggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataagatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcgcttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgcagtg

SEQ ID NO: 108707 - DNA, 2146 bp, Homo sapiens
  Payload ID: 1357
  Gene Symbol: RARS
  Gene Name: arginyl-tRNA synthetase
  Uniprot ID: P54136
  ENST ID: ENST00000231572
  CDS Start-End: 55-2037
gaggctgaccgtttccgcttccgtccacttggcgagtgagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaacca

SEQ ID NO: 108708 - DNA, 581 bp, Homo sapiens
  Payload ID: 1357
  Gene Symbol: RARS
  Gene Name: arginyl-tRNA synthetase
  ENST ID: ENST00000521329
  CDS Start-End: 30-206
cacttggcgagtgagacgctgatgggaggatggacgtactggtgtctgagtgctccgcgcggctgctgcagcagagtctcgctctgtcaagcagactggagtgcagtggcacgatctcgactcaccgcaacctcagcctctgggattcaggcaattctcctgcctcagcctcccaagtagctaggattacaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaacattaccaaacacct

SEQ ID NO: 108709 - DNA, 1990 bp, Homo sapiens
  Payload ID: 1357
  Gene Symbol: RARS
  Gene Name: arginyl-tRNA synthetase
  ENST ID: ENST00000520013
  CDS Start-End: 9-398
atgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcaggttttattaatgtccacttaagaaaggattttgtatcagaacaattgaccagtcttctagtgaatggagttcaactacctgctctgggagagaataaaaaggttatagttgacttttcctcccctaatatagctaaagagatgcatgtaggccacctgaggtcaactatcataggagagagtataagccgcctctttgaatttgcagggtatgacgtgctcaggttaaatcatgtaggagactgggggacccagtttggcatgctcatcgctcacctgcaagacaaatttccagattatctaacagtttcacctcctattggggatcttcaggtcttttataaggaatctaagaagaggtttgatactgaggaggaatttaagaagcgagcatatcagtgtgtagttctgctccagggtaaaaacccagatattacaaaagcttggaagcttatctgtgatgtctcccgccaagagttaaataaaatctatgatgcattggacgtctctttaatagagagaggggaatccttctatcaagataggatgaatgatattgtaaaggaatttgaagatagaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaatctgtgcacttccagacaatatttgctgctgctcaaatgattggttggtatgaccctaaagtaactcgagtcttccatgctggatttggtgtggtgctaggggaagacaagaaaaagtttaaaacacgttcgggtgaaacagtgcgcctcatggatcttctgggagaaggactaaaacgatccatggacaagttgaaggaaaaagaaagagacaaggtcttaactgcagaggaattgaatgctgctcagacatccgttgcgtatggctgcatcaaatatgctgacctttcccataaccggttgaatgactacatcttctcctttgacaaaatgctagatgacagaggaaatacagctgcttacttgttgtatgccttcactagaatcaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggaaaaatattgaaggtgaacatgtggcgtatgctgctatgtgaagcagtagctgctgtcatggccaaggggtttgatatcctgggaataaaacctgtccaaaggatgtaatccttcataggtttgaacactgtgtgtttttaccaaagtggccattggcactgtttgcttttttacaatcatgtggacacaagcataagtaaagaaaatttgtcaacc

SEQ ID NO: 108710 - DNA, 559 bp, Homo sapiens
  Payload ID: 1357
  Gene Symbol: RARS
  Gene Name: arginyl-tRNA synthetase
  ENST ID: ENST00000522834
  CDS Start-End: 18-359
gagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaaatgctcaaaaccaaggaacagaaagttaatccaagagaaattgctgaaaacattaccaaacacctcccagacaatgaatgtattgaaaaagttgaaattgctggtcctggttttattaatgtccacttaagaaaggattttgtatcagaacaattgaccagtcttctagtgaatggagttcaactacctgctctgggagagaataaaaaggttatagttgacttttcct

SEQ ID NO: 108711 - DNA, 177 bp, Homo sapiens
  Payload ID: 1357
  Gene Symbol: RARS
  Gene Name: arginyl-tRNA synthetase
  ENST ID: ENST00000626454
  CDS Start-End: 1-177
atggacgtactggtgtctgagtgctccgcgcggctgctgcagcagagtctcgctctgtcaagcagactggagtgcagtggcacgatctcgactcaccgcaacctcagcctctgggattcaggcaattctcctgcctcagcctcccaagtagctaggattacaggaagaagagattaa

SEQ ID NO: 108712 - DNA, 1818 bp, Homo sapiens
  Payload ID: 1358
  Gene Symbol: RARS2
  Gene Name: arginyl-tRNA synthetase 2, mitochondrial
  Uniprot ID: Q5T160
  ENST ID: ENST00000369536
  CDS Start-End: 47-1783
cgaggccggaactggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttggtcttctgggaactggcttccagctgtttggctatgaggaaaaactgcagtccaatcctctacagcatctctttgaagtttatgtacaagttaataaagaagcagcagatgataaaagtgtagcaaaagcagcacaggagttcttccaacgattggaactgggcgatgtgcaagcactttcactgtggcaaaaatttcgggacttgagcattgaagagtacattcgggtttacaagcgtctgggagtatattttgatgaatattcaggagaatcattttatcgtgaaaaatctcaagaggtcttaaagttgctggagagtaaaggactcctactgaaaacaataaaaggaacggctgtagtagatctctctgggaatggcgacccctcctcaatttgtactgtaatgcgaagtgatgggacttctctctatgcaaccagagatcttgcagctgctatagatcgaatggacaagtataattttgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgctacagaacatggcttcaattaagacaactaaagaactcaagaacccacaagagactgcagagagggtcgggctcgcagcactcattattcaggacttcaaaggtttactcttatctgactacaagttcagctgggatcgtgttttccagagtcgcggggacacaggagtcttcctacagtacacacacgcccgcctccacagtttggaagagacttttggatgtgggtacctgaatgacttcaacactgcttgtttacaagagccacagtctgtttcaattcttcagcatcttctcaggttcgacgaggtgctttataaatcatctcaggactttcaacccaggcatatcgtcagttaccttctaactttaagtcatcttgcagctgtggcacacaaaacactacaaataaaagatagtcctcctgaagtggctggggccagacttcatcttttcaaagctgtccgttctgtcctagccaatggaatgaaacttcttggaataacacctgtatgtaggatgtaatttccattaaaatggcttttaaaatgtcaagtgaa

SEQ ID NO: 108713 - DNA, 618 bp, Homo sapiens
  Payload ID: 1358
  Gene Symbol: RARS2
  Gene Name: arginyl-tRNA synthetase 2, mitochondrial
  ENST ID: ENST00000451155
  CDS Start-End: 1-618
ctttccagagtgttgaatcttccaccagaaaacttgatcacatcaatatctgcagttccaatttcccaaaaagaagtttcgctcttgtcacccaggctggagtgcagtggcacaatcttgactcgctgcagtctccacctccaggattcaagcgattcccctgcctcagtctcccaagcagctgggattgtagagaagtagctgattttcagctttctgtggattctttattggaaaaagacaatgaccattcaagaccagatattcaagttcaagccaagagactagcagagaagctaagatgtgatacagtggtgagtgaaatcagtactggtcaaaggactgtaaatttcaaaataaacagagagctcttaacaaagacagtgctacaacaagtaattgaagatggctcaaaatatggattaaaaagtgaacttttctctggacttccccagaagaagattgtggttgaattcagttcacctaatgttgccaaaaaatttcatgttggacatttgcgttctaccatcataggaaattttatagcaaatctcaaagaagctttaggacatcaagtaataagaataaattaccttggcgattggggcatgcagtttg

SEQ ID NO: 108714 - DNA, 13708 bp, Homo sapiens
  Payload ID: 1359
  Gene Symbol: AGO1
  Gene Name: argonaute RISC catalytic component 1
  Uniprot ID: Q9UL18
  ENST ID: ENST00000373204
  CDS Start-End: 214-2787
actggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattggaaaaaccaattctaaaatggctaaaactaggactttcaagttcaccacaactaccaccaattaggagataattgtaaaagaataaacaaaacctaattttgttcctagccaatattataaaccatgttccagcatactagataatagtagcatactatatttatttccataatttgtcttctttagagcctatgaactcctaggagcagaagctatattctcttcatttttgtcatctcagggtcatggcatataccaacagatcagtatgtgcaaatataattgaaataggctagtagtctgtggtttatgagtatgggctgggtgggcagtggatcaagaagtgataggagtacacaggatgaactcagaattcctgaatcttcaggtaagcagatacttaactacattatcattgtcttttcccactcaccccaagttggaggttctatggttttgtactttaagctggtggtataattgtcaagcatgtaaattctggcattcttcctggtactgctagagcattgttatttctatgcatgggggtaagaaggctcagagaaggatcctggcggataccccagtgagaaatcgtcagtggcagccagtgtgtacatacgtggacctagcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagctcaaggttttcagtgaaggcttgtcctggcacctctgggcattccttttcattactggttgagcatccttccttctgctctgtcaattggcaaaatatgctggagcacattctggactagcagttgccttggggtagtcaggctgggtatttgtttggtatctcttggtgtagcagaccccagaatctcatggcaattaggatttggtggctaaacgaaagagttagtgcaaggaaaagcctagttggaatttctgagtctgggccatccttaagctgctgtctactgcctgaatgggaagtaatgtcgaattggaaaattagctcaccatttttgttctagctttgcagacatttattcctctgatgataggctgagaaatgcctaggccggcttagaaggcacacagcatgacagaagtactccttcaaagcagctgtgtcaagaaggaagagctggaaaagtggatttgctggggaattagatgcatttagttttccacttacgcacaactgccttctccagtatatcataccaaggttttttaggcctttgtggcttaccctgcaggaacatactgtgtcctgttgttctggactgtagcatcttcaccaccatcctcttggcaatggttttttgtttggggtttttttttttttttttttggacaaagtataataatattgagggacctttctagggagcctttggtcctttgtccccattttccaaagggagggaactttcctcttaaaagagacagtgggaacttttagccaggtttttggaaaaggcctgtgggctattaatgagagtgagctgcaaaaggaggaagggtttgtttgggtactttgaagtacttagctaggtgttttctacagtatcttatataattgcatcttacagcatctttacatgcgaaatagtttatcagttatcttcaattgcatattacaaaattctgattaaatttttcttaaataagaaaactatcatttcatatgacaagaaatcctaatttaatgttactccaaggttggttaattcagtggctcagtgataacaccaaagactcagtttcttgaaatttttttgctctgccatcctccatgtttatcctcacgccagttcgcctcatggtcccaatatggctactgtaattctgggaaggaaatgctgacagaaccgtgtctggcaaaagagagacagatttttctgtgtccttctaaagcaaggaagtcttcccctggaagctccaacagatacggcctcatggctttgctagaaatgggtcatctcactcctgtcattggcaaagcaagtaagatcatccatcaggagtggcttagattaatgaattatcctttgagtcgtgtagactagaaagttcagtcatgtctactagcaagaaaggagataagggctgttggataagcagcatctggtctcaaaggtacttcaacttttacagatgagaaacatgaatcagagtgactttcccaggctcacagcaagtaagagagggccttcagtgttagctgtgtctgtccctaaagcccatgttttatattgtatcttgctagagtataaagtaacttactttctaccttgtagaaactgatggtctaggagaagagatttgaactcaggtgcccagttgactctaatcttggcccatgtgagaggattgtactcagttgctctcctcatccagtgatgtttcttgtctaacacaagaagcctaggagtagaaagtcctaagcagagtagaataatagcggcagcagggagggaagtgtgaactgtgtgtccctgagcctgacttactgggcagggacatgacacttaaagcggcagctggccactctgtctttcctgcatgcactgagtatttggtagctcattagtgaccagtgatattgatcatcttttcatgtgctcacttactatccccatatctttgttgtttgcatcttttacccattgtatttgttgtttttgagacagtgtctcactctgtcacccaggctggagtgcagtctcatgatcgcggctcactgcagtttctgcctcctgggctcaagcaatcctcccacctcagcctcctgagtagctgggcttacaggcgcacaccaccatgcccagctaattaaaaaaaaaattttttttgtagcagttcggtctcattagtattgcccaggctggcctctcttagcttcaagctatcctcccgcctcggcctcccaaagtgctggaattacaggcataagccacaagccactgggcccagcctcttttacctgtttcaaaattgagttttattgagttgtaagagttctttattcattttaaacacaagtcctttgttggatatatcttttacatctatttttcccagtctgtggcttgccttttcattttgaagagcaaaagtttaaaattttgtgaatttattaaagctccgtttgttgcttttttctgttctagtttatacttttgtatcatattttaggaaattttgcactgggtatttgatggctcctgaggaggttcaactttcagagcgcactgatttctctgcacctgagattttgtactatttctgtatttctttcttctcagaacaaccagtgtcaccaggtatgagggcagagttttagcttgtttgctgagccccattcttgaagctcatttatttattcacctatctgtccatcaatccaacaaatatactgaatgctgctatgtgccaggtactggcactgttctaggtactggggcaatgacagttaagataatacccaatgaccctgctctgtacccttaagagcagactcagttgggaatgagttatccaaatatagggtgtacatgtagtcaggagagagcctcatacagctttgcctttggcagaatccttcaaacctctttgtcttcctacttcttgatattacaaatcatgagcctttcacatgcattgactctaaagaggtgggttcctggatagcagaagtagataggaaggcatcattgacatttactgagatggattgaatcagagggtgtaaattctgctccatcaatgttgaaaaagactagcccaccccaaaggtttatcactgtcaccatgtctaatgtctattctggaagaagctgaagaagtctgcctttgtttagggaaccggttccagaatcagaggggttgaggatataaaagacccttgcacaagagttggtatttaccctgtcagatgctgctaccaagatttggattgtgtacagtcgaggattaaaaatgacttttaagatgcagtgtttcatctggtgacatttaatttgatattttaaaattggggagggtattttcagccatgggggtagggatgtgaaagaagaagaaagtaagaattggagtcagatgtggttttgagtcccatacatttattgtttaatattatatggtaagtactttaaaatggtaaatagtaaatacttgtgttattcactaacatttggggaggattttctctgtgctttatgtatattacctaaccttacaaactgtgtaaggtacatgctgttctctcaatttttcagataagaaaattgaagcccagagagatcaagtgactgatccaaagtcccacagtgaggggaactgaagataggatattctttctccttttcctctttaaaaaattattttgattaaaaaaaaccgtattactgaagcatagggacatggggagaaattatgaatgattcctcagcctgaataaaatagtatgtttcattaaggcaacaaatatttattaaggacctaatatttgcctgacattcaagtgaggtggggggcacacaagtagtaaataaataacagactgggcaaagggctaccaaggcaatactgtagtagactaacaggtgccccaccatagatgggtggtccggaaaaggcgtctcagatgtctttcgttgagacgcaaaaaaaagctgtggggtagggcgtaaggggagggtggagaagagagagagggttcctggccaagggaaccaaaagcagagaagctccaagtcagaaaaaagcagcggttggcccgttgggagaattggaagccaaccagtatagctgtagcacaggcggggcccatttacgccgtgcgttttcaccctggaaaggagtttgggttttcaagtgtgacgaggcgctattaaagagttttaaacatg

SEQ ID NO: 108715 - DNA, 3996 bp, Homo sapiens
  Payload ID: 1359
  Gene Symbol: AGO1
  Gene Name: argonaute RISC catalytic component 1
  ENST ID: ENST00000373206
  CDS Start-End: 297-2645
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatg

SEQ ID NO: 108716 - DNA, 2836 bp, Homo sapiens
  Payload ID: 1359
  Gene Symbol: AGO1
  Gene Name: argonaute RISC catalytic component 1
  ENST ID: ENST00000635259
  CDS Start-End: 1-401
agcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggccagggctcctccgtgcccaggatgcctcacagggtgggggcctgtgcccgagggaccagttctctgcctgtccctgccaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaa

SEQ ID NO: 108717 - DNA, 14581 bp, Homo sapiens
  Payload ID: 1360
  Gene Symbol: AGO2
  Gene Name: argonaute RISC catalytic component 2
  Uniprot ID: Q9UKV8
  ENST ID: ENST00000220592
  CDS Start-End: 114-2693
ggccgcgccggggcggatcgtgcggccggcggctccctcgcggctcgcggcgtcggggcccgtggcgcgcgcgcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtatttaaaaaaagaaaaaagacaatatactgacagtctaatcatcagatttgtcctataggactgtgacatttattttccaaagtttttaaagaatacgggtctgtggtgataaatacagtacaatcctttttcactgttatgtctttaatgtaagagaagaatatatatatctggtttgcagtattaatgtgatagatagatgctgttttttcattttattgactatggggtgcttctgtgatctgtttggcatatcaagagtgttttggagcctggagatgggaccgcctctcagttcttagtgcttaaggacaggaatatgcaattgacttaatgtgacagcaacccgcttcccccgtggagactgtgcagcgtgtacccatgggagggacggatgtgccctccgcgccgctcgccaccctccctgccgcctcatccccgtgtgtcactcactcagctgatgaagcacaagtggaaattatttattcttgcattgctgggaaacattgatgtgtggggactcactcctctccgtgtgctcttttgtcagatgacttccatagatctatgcactgagattcgtagaaagctgttggtggtggctctgctgggcgtgaggccgtcggtcacagcgaaggagcttgcctggccctgggaggcccaaggatagcagggccagcagagggcatgggccgttcttctggggtttgcatttggggccccagacttgggtttgccaatctagaaactgttgcactaagagtgacaccacggacgattttgaaggctaacaacagacaactctgtttgtgctgagtgggctttttgtctctgtacacagttttagtaagactcaaatccatgttccgtgtagaggcgtcaggaaggaggcgagcctcccctagtgctgctgtgcgctccgtaggtcccctcttcctgctgctgttccctccccggccctgcgcgacacttacctcggcactgtggtggggtggggtgccaaaggagctgcctcctgctcagcggcacccccccccccacctttgtgctcagctgctttggaggcagcaggaggggcagcaagccgcaggtcgggggtctcccgatacctcgcctggatattggcggcaatgacaaagggatgactattatttgtgaagatgtgtactcagagtggtgtgtgtgtgtgtgcatgcgtgtgtccctgtgtgtgagtgtcttattaatggcattagtctcttctggctgtatttttttttaatctttttaaatgacagaagctcccactctaagaaatggcagttccttttgttttagtggcaagtggcactttctcctgttttcagaaggatacagacatgctcgtagcttaaattaatggatgcattcaagctaaggagggaatcttgtgactaataacttttcaaatctgaaattagattagtttccagccatttttacaatcatctggaaccatgtgtctcaaaggtgtgtttcttccacctgcgtcaggctgtctgggggatggcggttcttgtttaacatgcagatttgtgggcctgctgccacctcctgcgtgcggtacttcagggatggccagggcatctgtgtctaagcgatggcctgcagccctgggctccctggggtctgaggacccagctctggtggcacccagcagggaggaggtgcttcctgagcagatgcctgagacagactgggctggcagaaaagtaggactacaatttttgttttttttaatcattttgaaggaaaactttcatttttagtgggccagagtacttcgaaaagggtacttttttatagccctatgcttgttttataaaacttttaatactaaaaacattaatagaccaaacatctccagctgggtcagctgcacacctttgtacatgtctgatgattcagagtttaaatggctgtagttacaatttctcaggtaaacaattgttttctcaaatttttaccaatccctgcattattaggataaattttgagacagtgtaaaaacctcaaagtacagtagggtaagtcccagccctgttcacgtgaaagccagaggtggcccttccccggcatctgatcgtctgatcatgtgggtgcctggggccttgccacccttccctgtccactgctgcccccctgggcctgtcaagatttgaggggtgcccactcgctggctttgtccccatcccactgttaagtaaggtgtgccttgctttaagcaaactgaatgtgaaaattatgtgtagaagtctgggtttgtttaaaagaaaaactgggattttatctcatctctttaaaagaggtctcccaattcgatttctgtactgggactcttcctggtgtgtttttacatgttcactttttaaaaacattgatgtactcccatccttttaccactaccctatcacatttgacaagttcttgctgtaatgacgacgcaattaacgaacaccaggggagcggtggaaagctgccctcgtgtgtgagcccttcggtgacgcaaagccaccgtcctgttgttttgtgtgtcctaagctcagattttcctggtttggataaattttgtaaaactgggcatagctgtacttttagaaagggatcgttttccttaagttttggttttctctggttcaagcagtctttacatgcagccttttgattgcacatcagggtctcccttttcttttccagatgatgttgcttttcggtggtggtctcacactcctttgaatgaatgtttgcactctagaaccacaaacgatgcgtgaccattgtacagcttgcccaagagggaactgttggaagcaggcagtgacctccacgctgtttgtttgaggctgacctaaactgctatcactaatgtttacccccgtgacggagtgcccattagaacagatcatgtcagttcagttcctgtagtggggttagtaggtggggggttttattgttgttgttatttgttacttttattgctgttaaatgcaaatattgctatttattttttcctttctgctctggtttggtttggccgacacagatattccagtgcatgtggtacctaatggatatgatagaaattatttccccaacttttataaattgcctaatgtttaccttcaagtttgctggatgatttatttttgaaagccacaaatgtgatttttctggatgaattgtttttcttatatatgcagcaatgtaattttacattgatctgcggggtggtttaaattttatttttacaaggcagtttttcagtcaaattatatatttgatacaatacgctaggatagaccggccacacgtcaggcagccgggacaccggagtgtccccaggaggcctttggggctggggtggcccgtggcttgttccctgcgcctctgggaactggatgagtccttcggcgggactgtgacccgctggacagttaaaaggatttttcatgggcattttcctacacataaggcagttccattaggaggagctttagaagtcgacataatccagacagtggacaatcccagtggcccagacaagccatacgacattttcctgtgacctctctctgacccatctctcacgctcatgagaaaaggaatgtacaataaatagaaacagaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttaaagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgcttatgcttctttcagtatgttttgccatgttattgtctaaagtgaatgtattggcttagccaaatcactacagaaggtggttcctaaataccttttagtttaaaaaaaaatgcagataaaggctacctctgaattctcaatagattcatcatgtttgctcttaagtgtagctgtccacactgaaaacagccaatatgttgcctgaataaactgaattgtgaacatctatctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgctttacctacaaatgggttgaaaatggcctcctctgtcctctcctctcttttatacactctgtaaaatcacaaaggtgcttcaacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgcagacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcttactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaatcctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctccccctctcccccctccccctccctctctctgtctctgtctctgtctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaatttaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcacctttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttaca

SEQ ID NO: 108718 - DNA, 3050 bp, Homo sapiens
  Payload ID: 1360
  Gene Symbol: AGO2
  Gene Name: argonaute RISC catalytic component 2
  ENST ID: ENST00000523609
  CDS Start-End: 41-262
cggccgcccctcggccccggagcccctcggcggcgccaccatgtactcgggagccggccccgggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggt

SEQ ID NO: 108719 - DNA, 3141 bp, Homo sapiens
  Payload ID: 1360
  Gene Symbol: AGO2
  Gene Name: argonaute RISC catalytic component 2
  Uniprot ID: Q9UKV8
  ENST ID: ENST00000519980
  CDS Start-End: 41-2518
cggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggt

SEQ ID NO: 108720 - DNA, 316 bp, Homo sapiens
  Payload ID: 1360
  Gene Symbol: AGO2
  Gene Name: argonaute RISC catalytic component 2
  ENST ID: ENST00000524328
  CDS Start-End: 209-316
agcttcatcccaccgggcaattttcctgcacagcagctgttacagtcccattctcacctggcccctgggccagttcggaagcctctgagcagcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcacttt

SEQ ID NO: 108721 - DNA, 3211 bp, Homo sapiens
  Payload ID: 1361
  Gene Symbol: AGO3
  Gene Name: argonaute RISC catalytic component 3
  Uniprot ID: Q9H9G7
  ENST ID: ENST00000246314
  CDS Start-End: 614-2494
ccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacaggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaatttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 108722 - DNA, 1726 bp, Homo sapiens
  Payload ID: 1361
  Gene Symbol: AGO3
  Gene Name: argonaute RISC catalytic component 3
  ENST ID: ENST00000324350
  CDS Start-End: 280-969
aggaaggagggtggccctaccccagcgggctcggctcggggcctccgcggcagttcggggtccttcacccgccggctccagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtaagagatggtgatggtctaatgtgggatggagaggaaggattaagctgaaaaaataggtttaagaaccatgtccagaaaaaaaaaactttgggtgtagtactggtacatggaacggattggaaaaaaatagaccagagctttactagatttttgaaagaattgtttttgcaaataaactacaagcctggcatatcagtcaaggttcagaacctagagaagcagaaccagtacgaagtatagagagagagtttatgcaattgtaggggctagctaggcaagtctgaaattttgggggcaggctgtcaggaagggcagggaaattcaggcatgggctgaagcagttatctataagtggaatttcttgctctcagggaagcttcagccctacttttaagacctttcacctaattgaatcaggcccatccacattattcaggataatctccattacttaaagtcaacagattatggattttaattacatctacaaaataccttcatagcaacacctagattagtgtttgattaaacaaatggcagctggtagcctagcaagttaacacattaaaaacaacacctgccatgatggcttacacttgtaatcccagcactttgggaggccaaagtgggaggatcacttgagattaggagtttgcgatcaggctgaacaacatagtgagacctgatctctacc

SEQ ID NO: 108723 - DNA, 19687 bp, Homo sapiens
  Payload ID: 1361
  Gene Symbol: AGO3
  Gene Name: argonaute RISC catalytic component 3
  Uniprot ID: Q9H9G7
  ENST ID: ENST00000373191
  CDS Start-End: 350-2932
cggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaactagaattctacttttattttgcataccctactcctgactcctatctcatacacaattctgagttctcaactcttgatattgctgtcttaagaaacaaaattttatatatatatgtatacatacatacacagacacagacacacacatatatatacataaaataactttctgtgagagtgcgtctctcccctcccactcagaacatacatttaccatttgcgcaatttgtatataagcagtagcaacctgaactattctttttcttttttctttttcttttctttcttttttttttttaatgagacagagcctcgctctgtcaccaggctggagtgcagtggcgagatctcggctcactgcaacttccgcctctcgggttcaagcaattctcctgcctcagcctcccgagtagctgggtttacaggcatgtgccaccacacccagctaatttttgtatttttagtagagacggggtttcaccgtgttggccaggatggtctcgatctcttgaccttgtgatccacccgcctcgacctcccaaagtgctgggattacaggcatgagccaccgcacccggcctactattctttttctttagtgagtttgttaaagctgctataaatataaaacctgtcagaagttgtaactttctctctggtaagtgatgtgtattctgaagccttctgtttctatgggttatacatggaaattctttaaaggttttataaagggtaaatattttaaaagattagagctctgtagggttgagacctctgaaattgagtagagagaagagtttgttgagggatttttttgttttgttttttgatagtttacttgctgcctctcataccttaatgtgattttcatatattttttatatatatatatgtatgtgtgtgtatataaacacatatgtatgtgtttggaagtatagcttccttttcttttatatttattagaatagtgctttaataattatagaattgtattggcagcatcttttatagaaatataatcatgtttattttaagaactgacaacttgtttttgctatcttttagtgcaataagcagttttaaaggaaagttgtgtctgcatctttaccatggatagtaggaggaacaggcacctccatagtttaaaagggcaaagaatacagccttaatttcagaaggaaagttttgtaattttcagttttaaagcatatcttttaaaattcatcatgataaaaggctggacgcggtggctcatgcctgtaatcctagcactttgggaggctgagacaggtatatcaccggagctcaggagtttgagaccagcctggccaacgtggtgaaaccccgtctctactaaaaatacaaaaattagctgggcgtggtagtgggcacctctaatcccagctactcgggaggctgaggcaggattgcttgaacctaggaggcggaagttacagtgagccaagactgcaccattgcactccagcctgggcaacaaaaccaaaactccgtctcaaaagaaaaaaaaatcataatgaaaatgaagtgaaattgcctaaatgagtccaacttgaatattagaaataaagttgaacttttatataattgtgaatagcttaacatatttaaattatttgcaaatagattgtgtttattgaagaatcatattggctagatgcccattttcatttactaaaatgaatcaggaaaatgcaagatgatattttaaaacttttgctaatgtatcaccagtataactttccttttaaaattaaggtgatagtaacaaaggaagttaggactttgatcattttaaatcagttaaatcactgaaacgtgggaaattgttttacaaaacttttattgattacactttaaggtattaaaaagtactataaagctatcaaaactgagtttatcagtaacattggattcaggggagctttgcactttgtaactcatgaaaattgcattttgattttttttttttttgcactggttcagagtatagatactacagattgtttccagtgggcattgttgttagcctttcagaattccatctgcacgtgaaacctaatggatttagatctttagtttctctcttacctgtaatccactattattgccaattcactgtattttgagcctaaaatctgagcccatgtcctctgacaggcatgaaatcttttgtccctctgccagaaaactaagaaagtactgtattttgtatgtttattattttgaagtgtctgaaatgcaatttacaacactgttgcaaagaactttacaaaaggtaatatttgtatcgtatatacattttttctcccagccttctcccatctcctccagaaaaatttcctataaagatggatttttttacactgaaattttactgaatatagtcaggatcatgggcaagagaagaaaatagtatacccaagatgataaaaatttaattcgtctatgcttgatcagtgtgagtaaaacatcttcctttatcatgggagctgcacagattcatgtgggaaactttagggaatgactgtagataccctttctctatgtactctctcacctaattttcagtcactcatatatgctagagtggagcccttaatttaaatctatttggaaggacttttttaagaggaaaaatattttttctaaattataaagctttaccttttgagtgatttcttttttagagtgctcttacactagtcagcattgctagtttaaagttgattaacttgaaagagtatgtatactatatttctattttgctaacaaattggtatattaattaccattggttcttaattacaagaaaacttgtgcttagaattttaagataaaaggctaagtgacaaatgcttcttgaaatttgtcctatttattgttgcatttctggtgtagaatttctaatcttttttattttaaaaaagtttttttttttaagttaaacatgaaattcacagtgacccttctgctcctgcccttgctcactaactatatcatgaatgctagattttggtcttcttttttctgtgatgtatcttacgagactgactgtaaaatatcagtctggcaactagataattgattttcatatgaagaagagttgggagtttaatgtatattcttgatggttaatgtgtctacataaagtgctgatacatgtattatatcacagtatcaggttactggcatggaggaccatacacttacaatattgtagctgctatatttatttaagtagattctgacagttactgcactaaacagtaaggagataagcaggattcaaggctagtgttagacccttttttttcctaagagtaaggacacggaatatcaaagtaacaaagggtgctgccattttagtttcaatttaatatcaggatattctttgttttagaaatgtagattttgacttttacagtttgaaaaagggtacctcagcctcttcagtactggttttttggcacatttcaacagaaatattagattccctttctttttcttaatagtgatcttctaacaagtttcttggaaaaactatcattctaagggaaatccctgtttataacctattaatatatttctattcctagaagagagtctagcagggattctagtaggaattactgagtgttttggaaggcacttgatagaggcatctctgctttccagcacagggattctcagccttctaaagatctagaccagtttccaagctagcttctccacagcccaccactgcctagtgtttgcttgtgtattctctaatggattttaggaggataggccttctgacagagtcatgaaagactgaaggcatgtctagggaaataaaacctgacttgcccttcagcaggaatgactggcagcggatctctgtgttcaaggaaagggtgagcgctaagcatgccagtgatggatccgaagtatttagatggattgcagaccaggaattagagaccgtttgtgactcaaggaacttgatggatctgtttagagccctacatgaatttgccaagggcagtgatttttatgaaattcaagaagcaaacgacttcgatacagctagaatatgttgcagtcttcctatttcaaacttgattttaatatttttaccaagaagtttaactgacaactctgcaaaattttcattcagtatcattaaacctgagttaaatgtttgcttagcttatcctcttagatgttcttctgttgaacaggcaggttgcccttaacagtaacttgctacttaaattaccttttattagttagtcaagctgcaaaaatatcattagtgtggcgtctttattttggctttatccatatgaagtattcattattttcattctttttgagaattcataaatgtcttaaagcttcagtaagaattgttgggaggtttgacatcaagtaacgccttcctgtgtagcagtataaccctaatttagaactcttgttttcctatttcagtcctcatatttgatcatagaaaagcacttttgtgattctataggagtcaaaaaatcagccaagagtaggtaagtcagtcagcacagaaatcagaaagtgagaattttctccaaaaaatctttttaaaaaagtcctgcttatactaagaacattcttgatccgttgcagtgttagaaatgacactgtgattagtgaaagccaagctgagtcccaggaagcagggagggggagtgtgtgtgtgtgtatatgtatgagtgtgtatatatataatctcacacacacacacaaagggaaaaattattttgacttttttcctacttttaaaatggtacatttaagtttataattttccatgtcagtcaacataattttttaaactaaggtataatggtcaaggcttgtgctaatattacctactactcattgaaatttatattactttacccatcaaaactagtactccagatgtttacatcattgattaaatctcaagaatcttttgttcttaaaatatggaagttaaagattttaatttgaattaaagatagaaggatggtaaattcaatatagagggttgagatttaccagtgagaaaccctgttgaagtatcaggtaaatggtgtgacaaaattagaatcctgtcaaatcacctatccagccatcggggtcccttccttttttagactaatttctaaggtaaccagaatctaatgtatctatgttagggtctcagtaaagcaaagacgtttgtcagggcgtagactcttgagttaaattttttaatcattttttaaagcaaggcggttcttagaaagtgccttttcagaagatggtgctgtagatttttatttttcaagtagcacgaagctaagaattttaaagataaattattttagaactccaagagtgtgacagtttcataaaaataatgttagttgttgtcttgaatctcgtccaagggaaccaaggaaagcttttatgcagtaaagtatctaggtaaatgctcaccaaatttattttgtaaatttgaaaacaaaatatttagtagaattacctcttttaattcccaactgtgttggaggaaatccataatgcacataaaacagcaaacctacttaactttttaacaagattatgggtatagtaccaatgtccaaagggaaatgtaacttgcctggaatcataggcaacattttctaattaatctttttttttttttttttttttgagacaaagtcttgctctgtcacctaggctggagtgcagtggctcaatctcagcttactgcaaactccgcctcccgggttcaagtgattctcgtgcctcagcctcccaagtagctgggattacaggcatgcaccaccacacccggccctaattagtcattattaaggaggactgctcataaaggcagtaccaaatcatcattcagatcagcttaagtgagaaagcaaaatgataatctctattgttagagaaattttcttttctagacaccaaggaatattttaaatgattttttattttttctaggatgcaggaactatgaaaaatgatgacaaggcatttaaaagggtatgatcagttaaatagaagtagggtctgcaaattgtgcttaaggggaaataagcaaaagaaaggaaaatagtagaacctttcatactaattagaaatgtagttacctaccagagggcaattttgctccataccaggaagcagtaaatagcagtaaatgatcacctaggcacttctttcctgtgaatttggtgagcattcttccagaaaagaagactaaaagcaaacaacaacaacaacaaaaaataccacacctcagtaaccttgtatgctgcattatataataatgatagtaaaattatattgtttggagtgtactgtgtctgtttgcaaatatacatgcacattaaacttttttgtttttataatgtcttaatagcaattatgagtttatttttgttaagattaatttttctattgtgatgtttatatttattggcaatttgtatgcaacttttatattttgcttgtcggttttaaggtattttatttttatagatatttctagctttcctcattctttgtaatagcagcaaagattaagatggagtgttaatataccaaccaaactacgaattccataaactctagagtttggatttttaccaataaaccattaacactattttgtaacttagaatatttaatgttgtttatatagtgggcattaaagacagtctttagacagatttctacatgtggaggggaggtggggctttcctgtaagtttgatcctttttttcccctttagtagcaaactaacataacagattggatttattttacctgactacagttttggggaaacctgtcaaataaataattgttacatgccttttttttttaaatttaagcacattgaaactgcttaaatggtcacatttttcagcattaggattaagataccatttttgtaggcctggaaaacaaatagcaaatgattcaaaattcattgaattgactttgaaatgaaacttttcccccataatttgttatatggaagatttgctaccctgatcttttccctagcatacttctaaagttgattgaatccctgagtatcaatgaagaaatcagagtttaagtggctagggagagccaggtataaagactgattaatagagtacttcagctaattaaaaatttaaatagtaataatttatgaatgtgaataaattggaaggcagcaaaaagcatgattatagaatattaagttcaattatatatagacagtccagtttcctagtgaataggtcaagattatttgttttgttttgtggcactatcatagttcactataacttcaaactcctgggctcaggctatcctcccacctcagcctctgaagtagctgggactactcacatgcgccaccatgcccagctaatggtttttttctttagagatgggggtcactatactgcccaggctggtcttgaactcctaagctcaagtgcttctcccacatcagcctcccaaagtgctgggattacagccatgagccactgcatctggccaagatcaagattatggatattggtatgttaacttttaaaataaaagtacatgggctgggcgcagtggctaacgcctgtaatcccagcaatttgggaggccgaggcaggcagaccacctgaggtcaggggttcgtgaccagcctggccaacatggcgaaaccccgtctctactaaacatacaaaaattagctgggcatggtggcacatgcctgtaatcccagctactcgggaggctgaggcaggagaatcacttgaactcgggaggcggaggttgcagtgagccaagatcgcgccattgcactccagcctgggcaacaagagtgaaactccatctcagaaaataaaaataaaaataaataaaagtacatgaaaaaagtatattcccttaagcaggtaaaatacttgcattgtatttttacatcatgaatttgcttgttaagaaatttcttttctgtaagtggttaaaagataaactgtattccatcctctgggttttcaattctaaattattggagctcaatgtatgacattttactgtagtgtattccactgagaggcaaggaaatgggaaagtgtcaggtaattataaatgggaaaattttatttttatatgatgtaaagttttacagtttaaaatagatcagcatgtgatttcttgtagagattagccatttcatttctttttgcatttttgccagttacattagtttgccctatgatatactattctgagatacttcagccccgcacacatcaagtactaattgtatacagatagtacagatttgtactctgattataagaatttgttactactaattaaaagcaaattaatgtggctgggcgtggtagctcacacctgtaatcccagcactttgggtgggcggctgaggcgggcggatcacgaggtcaggagttggagaccagcctgcccaatatggtgaaaccctgtctctactaaaattacaaaaattagctgggcttggcggtacgtgcctgtaatcccagctactgggaaggccgaggcaggagaatggcttgaacccaggaggcggaggttgcagtgagccaagatcacaccactgcactccagcctgggcgacagagcaagactccgtctcaaaaaaaaaaaaagcaaaatatttttgctgtgattgtatgtccccttttaaggatatttattgcgcttataaccttaatagttgtattcattacatttcaacatgtccaaggttagcagacatgtagttcctgaaaaccaacattttaaaagttgcctctgggctgggcatggtggctcacgcctgtaatccctgcactttgggaggccgaggtgggcggatcacgaggtcaagagatggagaccatcctggccaacatgctgaaaccccatctctactaaaaatacaaaaattagctgggtgtggtggcacacgcctgtagtcccagctacttgggaggctgaggcaggagaatcacttgaacctgggaggcggaggttgcagtgagccaagattgcaccgctgcactccagcctggcaacagagcaagactccatctcaaaacaaacatacaaacaaaaaaaggtgcctctggtcctgtgttttctttttccttctgaaagttcatagaaacctggcatatagagcttattttgctgttttaactggttggctccacaaatcctgctacctgacatcagtacagcttgaccgcagtgaagtacttgatggcttgttcatgtttagttcacctctttagaaagaaagctttgtggccaggtgcagtggctcacacctgtaatcccaacactttgggcagctgaggtgagcagatcacctgaggtcaggagttcaagaccagcctggccaacatggcaaaaccctgtctcttctaaaaatacaaaaattagccgggtgtggtggcggaggatgcagtgagccaagatcgtgccactgcactccagcctgggcaacagagtgagactctgtctcaaaaaaaaaaaaaaatcgttgtgcagtaatagatcatcccaaaaaagaattgccatgaacagcgttatgcgtagaaaacagatggaagtgttggtcattagagccttgctttttaaattttattctttccaaaaattggcggtatgctatctataattttatgtttgatgttgaagaggcaacaccagagactagagagggagattactctgatatttagtgcctaaaactttcatcttggccgggcacggtggctcacacctgtaatcccagcacttcgggaggccgaggcaggctgattacctgaggtcaggagttcgagaccagcctggacaacatggcaaaacccgtctctactaaaaatacaaaaattagccaggcatggtggtgggcgcctgtaatcccagctactcgggaggctgaggcgagagaatcgtttgaacccggtaggcggaggttgcagtgagccgagatcatgccactgcactccagcctgggcgacaagagtgaaactccgtctcaaaaaataataataattttaaaaataaaagacaaaactttcatctttatttcatggctttatttcatctttatttcatttttggttgggaaaacaaacaaaaatctcttaagttagtcctttaatagtctttttagaaccaaagaaggaaagactgcaaaaatgttgcatacgtgactctttattgtcagaatctgtagaaactggaggtctttgtaaagaaatagactagtaggattgtgagaatatatagtgaggggggatttaggataaggcttccttgctgggatccttggacagaaaccttacaattgtttaatatttgcagagtaaaagagcagctattgctatttgaacctacagaagagacctaagacgagcgtctctgtaatctaaatttatatgataatgttgtcccagacccaaaggcacacctattctcagtaacttagagaagtcttggaagttgcttctgaattacagtaaagaaattaaatgaagtctttatccttaaatagggccaggcattgctatcaacatagtgtctttggttttcccctttaaatagaaaacaccaagcagggcctttccagacaatgtagtctttcctgtaaagaaaatggttttggtgtgggatttggtaaaaacactggttagtttgtaatgaagaaagaattttggcatagacagtccgacccagttcatggatacagtttgatcccagggagtttaacaaaaggaagctttggttttgctagcaacagacttgatcttctatagtaattaattgcaattaaggttttccaggagctttctcatttcttagcccagggtccaaccccattccctctttaaaaaagaaagaataggccgggagcagtggctcatgcctgcaatcccagcactttgggaggccaaggcaggtggatcacaaggtcaggagtttgagaccagcgtggccaatatggtgaaaccctgtctctactaaaaatacaaaattagctaggcgtggtggcaggcgcctgaggctgaggcaggagaatcctgctagtctgaattacaataaggaaattaaatgaaggatttatctttaatagagccaggcattgctatcaacataacatgtttggttttcccctttaaatagaaaacaccaagcagggcctttccagacaaggtagtctggaacccaggaggcggaggttgcagtgagccgagatcccaccattgcactccagcctgggtggcagagtgagactccgtctcaaaaaaaaaaaaaagaaggaataggaaaaggacttagaggcagttgatatagaattctactgggggtaaatgacactctcaaaatacttgggaaagaagaatcacatgccacaagctatagcttgattaatattttagcatgttttccatgtttgtattctaaagtttgtttcctttgacattccattatcttacttactagagtgccaccattcttatttgtaatacaatcagtgttttatgccatttgtgaatcacacaattgttcttttttccccatcacacacactcacacacaaacacacacactgttaaaaataaaagaggggaaggataaaacaaaaatagatagaatgatgattattacaatgtaactttaacatatatgaagagaaattctaactcagttaagtgagaattaagattgaaagtattaatgttgcaagtattatctctagccatggaattttttgctggctatagaatgctaatgtgaacagagtatatatcaggaatatgatgtattatggcacagtgataatattattgttgatattagccagatgtggtggtttgcacctgtagtccgaacttctcaggaggatgaggcaggaggatagttgagcccaggagtttaaagcaagcctgggcaatacagcaagaccccaatctttaaaataaataaataaataagaattattcttgaaagtaatattctaaccttctgccaaccaacagagatcctcatattcttaaagaaaattaatatagcttatggttttgataaattggactctgatttaaactttaaaatgttatgacttttattctgatacatggcttctaaaatatgtaaaaaattatattgaatgaattaatacttaacctgttcatttctcttaatttatgtatttattctgactttattatacagcttatgtctcacatctgccttcttgatatgtgcaaaatattgtgtaaaaatagtttaaaactcatcccagttcctagtcaagcgtgggctataagagagaaggcttaaggtgttctttaatggaggaacttttgaaagatcacaaatggaaaaagcctattgagaatttattgcctttgagagtagaaagggctctagaatatgagccagagacttggaatttagtaataggtctcccactgatttgctccgtgtccttaggcaattcgtttaatctctgtgtgcctagtttccccttgtaaataagagtggtaatacctgtcctcacctacctcactaaattgttggagttcttttgttctgagtcagggtctcactctgttgcccaggctgaactacagtagtgtgatcatagctcactacagcctccaactcctgggcccaaactatcctcctgcttcagcctcccaagtagctgggactagaggtacatgccaccacacccagctaattattttcttttattgcagagatggggtctcacatgttgccaaggctgatctctaactcctgagctcaagcagtcctcctgcctcagccacccaaagtgctgggattataggcatgatcactaaattgttgtaagaataagataatgtttgcggaagcatttgagttctccaaaggaaaagctattcagacgttcaagataatagaagagtgttgtgtgaaggattcctttccagtttgcctctgtgaaaatgtctttgttgtagatcattttatgaaataggaataagagaaacataggccttatcatggtgtagtgttcacttacaaacatatcctgttgtttcttccctgcaagatatccagcacacaggctgaatttttctttataataatccttggcaaaagcataacttttcaaaaaccaaatgattttagtggtgctatggcagctgcagttttgagttagattaatgtggtgaaaaccatcaaatacttagaaattgactgggtgcggtggctcatgcctgtaatcccagcactttgggaggccgaggtaggtggatcacttgaggtcaggagttcgagaccagcctggccaacatggcaaaaccccgtctctactaaagatacaaaaattagctgggcacgatggagggtgcctgtaatcccagctactcgggaggctaaggtgggagaattgcttggacccaggtggcagaggttgcagtgagccaagattgtgccactgcactccagcctgggcaacaaagcgaagctctgtctcaataaaaaaaaaaataataataataaaatacaaatacttagaaattaacttcgcctttgccttcaggcacttttgctacatgttagcatcagaggctattgtacaactagatggttattccctgtttcttggccgatttttggtacctttctttgaagaagagggttagattttaagaaagaaagtgtgcttatttcactcatgtctttgcagaatttaactttgctttactttaaaaattccaatcatcatgtacctataaaggttaaaatatagtgaaagtttctgcttcatgtgaattcaattctgagcacctgcaggtcatatcaggtgtctgatgcagttacctttatagatcgtggcaggtccttacatttcaacaggcttatgcatttccatggggggaagagattctgtttctaggaaattacaaagggcacaccactgcagggagtgtaaacaattctttgttgcaacagacaagattttttttaaaaaaagaaaaaaggatgcattttaggtacacagggtatggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccactagataattgctgctaaaaacaaaacaaaacaaaacaatacaaaacaaaaaaaaccctaagtaatggaggaagaaatagcattcttttaaaaggggcttttctgaagagtaaaatgtaaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactattcttgccaaatatttctactgaaacccagtttcagcaaggcaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggaaattgaaactttatggtggagaatggatgagagcaagtctatgatatatatgtagtcattgtataattagaaacaccaaatgctgaatcctatcactgtgttcttgggggccaggccttggatttggttgtcatttaaactccttgaagattatatgtaattataatgagcagaaggcaaataaagtttttgaacaaaagtccttgttttcagtatttaaaatttggtaatatattttctttttcagttaaactatcttccccacaaaaaatattatacttcagttaaactatcttccccacagaaattattatactacgaacaagttatgagtgagactgagaagcttgaagaagctggtttttaagcagctcatataatattttgtgttaaagaaagtgtcattgtttcctgttgggaggcaaataacaacaacaacaaaagaaattgtcatgattctttctgagccaaactgtcacgaaatgttctgtgacagaaccactactcttttttctgccattctgcctactggagagttctatgttgtatttgtttttaatccttgattttaaaaatattaatggttttagtgttgcttagcttcagtttgaagtataactttcactaataactgcaataaaaagaaaagctttgctcttaaa

SEQ ID NO: 108724 - DNA, 1035 bp, Homo sapiens
  Payload ID: 1361
  Gene Symbol: AGO3
  Gene Name: argonaute RISC catalytic component 3
  ENST ID: ENST00000397828
  CDS Start-End: 346-1035
gagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatag

SEQ ID NO: 108725 - DNA, 3599 bp, Homo sapiens
  Payload ID: 1361
  Gene Symbol: AGO3
  Gene Name: argonaute RISC catalytic component 3
  ENST ID: ENST00000634486
  CDS Start-End: 333-527
ggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacaggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtttcagtctacatgttacttccttgagaagcagtgtttgacacccttctcccccaatccagccatcccccaagtctgatttctgccactgccttctacaaagcacaacctgtaattcagttcatgtgtgaagttcttgatattcataatattgatgagcaaccaagacctctgactgattctcatcgggtaaaattcaccaaagagataaaagaaaatacaagatgtacagaacaaggattcaactgctgcccgaagagcatggactcgatcttaacttcaactgctcaggggcccaaagaaatgactgaaaaaatgactagaaagcataataaagttgatgttatagtgaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgc

SEQ ID NO: 108726 - DNA, 7116 bp, Homo sapiens
  Payload ID: 1362
  Gene Symbol: AGO4
  Gene Name: argonaute RISC catalytic component 4
  Uniprot ID: Q9HCK5
  ENST ID: ENST00000373210
  CDS Start-End: 246-2831
gcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcactggactgaatttttacctcaatgtgcaaaggctgatcagcctgaactttctaaaggactttacaagaagggtttctatggaatattttgctagctgtggtgttcaccgcatccctctagtcttagaagagaagattattccttttttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaaggggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaa

SEQ ID NO: 108727 - DNA, 1876 bp, Homo sapiens
  Payload ID: 1363
  Gene Symbol: ARHGAP19-SLIT1
  Gene Name: ARHGAP19-SLIT1 readthrough (NMD candidate)
  ENST ID: ENST00000479633
  CDS Start-End: 11-1564
gctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaagggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactgatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatgagcaca

SEQ ID NO: 108728 - DNA, 1598 bp, Homo sapiens
  Payload ID: 1364
  Gene Symbol: ARIH2OS
  Gene Name: ariadne homolog 2 opposite strand
  Uniprot ID: Q8N7S6
  ENST ID: ENST00000408959
  CDS Start-End: 237-1109
ctccacaggcgggcgttaaaccgcgcgggcagcgctgcgagagctcccaaagatgactcgagtggtgagccccgaggcggcgcgtttccccgccgcgccagacagggagagagggcctagatgtgccggcgccggttggtcagaggcggtggcctctgacctttccgagagctgagaaggcggcgggaggaaaaaaggcagacacacgctgggcgcccggccgctgacggcgggtaatgctcggacaacgtgccggcgacggggagcgcccgggcctcccgggcgacggcgaaggcggagtcccggcccggccagggaggcgcgcggagaggcccccccagcggccagccaaggtaaacaaggccgtgacgtgcgccgcgcacttaccgggagctgcggcctcgcggccgctgagcccgaacaagccagaccgggtcaggccgggccagagggaccggattggggcgaagcggcagcggaggcggcgggccgacgccggtcaagcccgcgctgcttcctccagaagagtcgtccccacagctccggaagtgcttggcgccgttgcgtcacttccggatcggggtcgacccacggtcgctcgggtcgcgacaggctcccggctagagggcctgtttagcgccgcctccttgaaacttagcgctctgacccagagtctgaccagggtacggcaggcgccgaccgcgtctggagccactattcgcctaccagcgtctcccgtcgagatgtttttaaccagcgcgtttctcaccggcttctcatttcactgtttgtactccgggatcgggcacggagaagacatcctggcgtcagtggagcagataaccattgtttctcggccgctatctggtcagaggggagctgggccgggaaattctgcctacaccccgaggcggtcgcagggtggccccagagccgcaaccacaccaggctttcgcttcccctgccgaggcctcgttcgccgcgcagttctccgacttacggtcaccgtgcaagattgcatcttaactgccttgcttgcagtttcttttcacagtataggagttgtcatcatgacttccagttaccttctgggaccggttgtcaaatgatgtggctagagacggaggctcactcagattgttgctgcaccacaatggaaatgccagtatgaagccgctgatgttaggaaggctccaggttgtgcaattccatagacaacaaatcaaatcatttccaaccatactggagtcgcgtatatacatattcaagacacctgtgcaggccgggcgcggtggctcaagcctgtaatcccagcactttgggaggccgaggcgagtggatcacgaggtcaggagatcgagaccatcctggctaacacggtgaaaccccgtctgtactaaaagtacaaaaaaattagccggacgtggtggcgggcgcctgtagtcccagctactcgggaggctgaggcaggagaatggcgtgaacccgggaggcggagcttgcagtgagtcgagatggcgccactgcactccagcctgggcgacagagcgagactctgtctcaaaataaaataaaataaaataaaaaataaaacaaat

SEQ ID NO: 108729 - DNA, 21681 bp, Homo sapiens
  Payload ID: 1365
  Gene Symbol: ARIH1
  Gene Name: ariadne RBR E3 ubiquitin protein ligase 1
  Uniprot ID: Q9Y4X5
  ENST ID: ENST00000379887
  CDS Start-End: 315-1988
gctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatg

SEQ ID NO: 108730 - DNA, 612 bp, Homo sapiens
  Payload ID: 1365
  Gene Symbol: ARIH1
  Gene Name: ariadne RBR E3 ubiquitin protein ligase 1
  ENST ID: ENST00000564062
  CDS Start-End: 1-612
ctcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttg

SEQ ID NO: 108731 - DNA, 807 bp, Homo sapiens
  Payload ID: 1365
  Gene Symbol: ARIH1
  Gene Name: ariadne RBR E3 ubiquitin protein ligase 1
  ENST ID: ENST00000570085
  CDS Start-End: 151-654
cgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaagtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtag

SEQ ID NO: 108732 - DNA, 478 bp, Homo sapiens
  Payload ID: 1365
  Gene Symbol: ARIH1
  Gene Name: ariadne RBR E3 ubiquitin protein ligase 1
  ENST ID: ENST00000561770
  CDS Start-End: 1-142
taatgaggatgatgcaaaggcagcaagagatgcacaggagtgtctcgctttgtcgcccaggctggagtatagtggcatgatctcagctcactgcaacctccacctcctgggttcaagtgattctcctgcctcagcctcctgagtagctgggattacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgaga

SEQ ID NO: 108733 - DNA, 604 bp, Homo sapiens
  Payload ID: 1365
  Gene Symbol: ARIH1
  Gene Name: ariadne RBR E3 ubiquitin protein ligase 1
  ENST ID: ENST00000562891
  CDS Start-End: 1-345
cgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgta

SEQ ID NO: 108734 - DNA, 4933 bp, Homo sapiens
  Payload ID: 1366
  Gene Symbol: ARIH2
  Gene Name: ariadne RBR E3 ubiquitin protein ligase 2
  Uniprot ID: O95376
  ENST ID: ENST00000356401
  CDS Start-End: 340-1821
gcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaatgtgtctagagtctttcttcatggggtctaggtagtcttctgagcccacaggggtctggccagtgaacaccagaggagtgccttcctatcagtcagccccttcttccagagggctgtggaggccccagtggccaaactcggctctgttttccctttctggctgttgggggagagggcacctgtaagtgatccctgtggaatgaagtagaaaatcctgccagttttccgctctcctctccctcagtacaggctgaatcattccccaccacagatagatcccagggttgtggtagagtactgatataaatgtcccaacccccccattctgagacctccggacccctccaaagcagacatgggaatgtagggctgtggaatatggcagggtgaactccagcttcacgggagccctaagggttatgaagagacaacttggggcagaaacaagtgtggagtctaatctcaagggtgaaggacaggaaatgaggtttggattgattaagggggtccacatttgtggtgtcagaagtggcagtagtgtcagtgataagtagctcaggggtagagtggaggctccatagctgtgggcaacatgcacagggcacctgtggctagaagaggcctcatacattgccagtctgaactccgcagctcttcctctggacctcaggtgtgccaagccccacgcttggcacctgggcatacagtggtatgcaagtgattcacgtgctctagcttccaggagcttccaatccatggggaacatagaaggaattgatcactagtgaatgtttgttttttgttttgagacagtctcgctctatcgcccagactggagtac

SEQ ID NO: 108735 - DNA, 598 bp, Homo sapiens
  Payload ID: 1366
  Gene Symbol: ARIH2
  Gene Name: ariadne RBR E3 ubiquitin protein ligase 2
  ENST ID: ENST00000452882
  CDS Start-End: 276-598
gcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacag

SEQ ID NO: 108736 - DNA, 884 bp, Homo sapiens
  Payload ID: 1366
  Gene Symbol: ARIH2
  Gene Name: ariadne RBR E3 ubiquitin protein ligase 2
  ENST ID: ENST00000420814
  CDS Start-End: 562-884
gacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacaggtgcatgccatcatgcctagctaatttttgtattgttagtagagatggggtttcacgtgttagccaggatggtctggatctcctgacctcgtgatctgcctgcctcggcctcccaaagtgctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacag

SEQ ID NO: 108737 - DNA, 753 bp, Homo sapiens
  Payload ID: 1366
  Gene Symbol: ARIH2
  Gene Name: ariadne RBR E3 ubiquitin protein ligase 2
  ENST ID: ENST00000430423
  CDS Start-End: 340-753
gcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccac

SEQ ID NO: 108738 - DNA, 2278 bp, Homo sapiens
  Payload ID: 1366
  Gene Symbol: ARIH2
  Gene Name: ariadne RBR E3 ubiquitin protein ligase 2
  Uniprot ID: O95376
  ENST ID: ENST00000449376
  CDS Start-End: 447-1928
acttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaa

SEQ ID NO: 108739 - DNA, 2778 bp, Homo sapiens
  Payload ID: 1366
  Gene Symbol: ARIH2
  Gene Name: ariadne RBR E3 ubiquitin protein ligase 2
  ENST ID: ENST00000452385
  CDS Start-End: 842-1162
ttttgtatttttagtagagatggggtttcgccatgttggccagtctggtcttgaactcctgacctcaagtgatccacccaccttagcctcccacagtgctgggattacaggcatgagtcaccacacccggccagtagaactctttaaacctgaaaaatcagtcaactttgcagactagaggaggatgttgaacacctatgtgtgttttttttttctttaccaactatgcacctatttttcagacacctaaaagtaatgtctgtgaaacagtggttttctttttctacatattacagcaggaagtgttcctatttatgtactgtctgtatcaatactaacggggcatgataagcaaaattttaaactttggtagttaaacctttatgttgcctcccctctgggctgccagctgtggggatgtgcttctcccttaaggactttggcaagaataacaagttcattggaatttgactttctgacatagagcagacagccttgccctgtcatgccaggcctttcatgtgaagttaccatttattagctgcttctgtctctccagggaaggatttcccttttataagcctgggccagggggatgatagtaagattccccatgtgataccagagttggaataggctgtagtgagattagggccaggactgtcccattttgattcttgaatggtttctgttacaacttgtcatggggaaaaagtaacacttattttttttttcctcccttagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggccgttgatgctcactgccatcagctgcatcctccctatggcactggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgtttt

SEQ ID NO: 108740 - DNA, 678 bp, Homo sapiens
  Payload ID: 1366
  Gene Symbol: ARIH2
  Gene Name: ariadne RBR E3 ubiquitin protein ligase 2
  ENST ID: ENST00000449729
  CDS Start-End: 424-678
actcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccggctcaagtgcagtggcgcgatctcacctcactgcaacctctgcctccctggttggagtgattctcctgcctcagccttccgagtagctgggattacaggtgctcgaactcctgacctcagatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaag

SEQ ID NO: 108741 - DNA, 560 bp, Homo sapiens
  Payload ID: 1366
  Gene Symbol: ARIH2
  Gene Name: ariadne RBR E3 ubiquitin protein ligase 2
  ENST ID: ENST00000433170
  CDS Start-End: 394-560
tggaggaagcagcgcgggcttgaccggcgtcggcccgccgcctccgctgccgcttcgccccaatccggtccctctggcccggcctgacccggtctggcttgttcgggctcagcggccgcgaggccgcagctcccggctggagtgcagtggtgcagtctcggttcactgcagcctccatctcccagatcaagcaattctcctgccgtagcctcccgagtagctgggattacagatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcc

SEQ ID NO: 108742 - DNA, 2876 bp, Homo sapiens
  Payload ID: 1367
  Gene Symbol: ARX
  Gene Name: aristaless related homeobox
  Uniprot ID: Q96QS3
  ENST ID: ENST00000379044
  CDS Start-End: 212-1900
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaaa

SEQ ID NO: 108743 - DNA, 2392 bp, Homo sapiens
  Payload ID: 1368
  Gene Symbol: ARL2-SNX15
  Gene Name: ARL2-SNX15 readthrough (NMD candidate)
  ENST ID: ENST00000301886
  CDS Start-End: 27-368
gcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagtgacctgggtttacgcttcaccacagagaaggaacttttcagacgctcccttggccgcgcacccgggatcggaacagcgctgtcacttgcgacaaaatccctaggccagaggaagaagagcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcgctcctgcactgccagccccttctcctctccccagggcctggccctacctcctggtcttgtaattacaggagccatttctgtaggtaactggaccaagaatgagaaaaataatgaattcttagctccctgattacacctgccaccttggaatcaaggactcacacttctgaccctgcctgtctttttggggtttttttgagttggagtctcgctgtgtcgcccagactggagtgcagtggtgggatcgcggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacac

SEQ ID NO: 108744 - DNA, 3032 bp, Homo sapiens
  Payload ID: 1369
  Gene Symbol: ARMC1
  Gene Name: armadillo repeat containing 1
  Uniprot ID: Q9NVT9
  ENST ID: ENST00000276569
  CDS Start-End: 246-1094
gaggcgtcaggtcacctgggaagagtctgcagagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacgttttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctatagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattata

SEQ ID NO: 108745 - DNA, 2849 bp, Homo sapiens
  Payload ID: 1369
  Gene Symbol: ARMC1
  Gene Name: armadillo repeat containing 1
  Uniprot ID: Q9NVT9
  ENST ID: ENST00000458464
  CDS Start-End: 372-914
ataagcgacagaggcgtcaggtcacctgggaagagtctgcagagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaatctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacgttttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctatagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatatt

SEQ ID NO: 108746 - DNA, 1050 bp, Homo sapiens
  Payload ID: 1369
  Gene Symbol: ARMC1
  Gene Name: armadillo repeat containing 1
  ENST ID: ENST00000518908
  CDS Start-End: 480-1050
cagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcggtatgtggggtccacgggcggcagacaaagcagtggagccgggaaggccgcgggaagcggcccctgtaccgaggcagcgaatccgcctgggaggggcgccccgcctgcctcttgtcagatccagtagtgggtcccagtgaggcgctttagcacgctctacccccacgtgtcccgtgaatctgttagctttgctcatttcttctttgtcccccctcacatctgacttttactaaccccagtattattaatgggtgtcatctcatcttttcatctctccagaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatt

SEQ ID NO: 108747 - DNA, 686 bp, Homo sapiens
  Payload ID: 1369
  Gene Symbol: ARMC1
  Gene Name: armadillo repeat containing 1
  ENST ID: ENST00000519352
  CDS Start-End: 316-686
agagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcggaacctttaactgaccagagtgctcattaaacgatgagaagtattctttgtcatagaatgatttgtttgtccaagttgaactaaacaagagaaagtaaagaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagat

SEQ ID NO: 108748 - DNA, 887 bp, Homo sapiens
  Payload ID: 1369
  Gene Symbol: ARMC1
  Gene Name: armadillo repeat containing 1
  ENST ID: ENST00000528721
  CDS Start-End: 210-518
tttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaatctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaag

SEQ ID NO: 108749 - DNA, 1668 bp, Homo sapiens
  Payload ID: 1370
  Gene Symbol: ARMC10
  Gene Name: armadillo repeat containing 10
  ENST ID: ENST00000306450
  CDS Start-End: 324-569
ggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagatgagaaaactgagacccccaaaaatagtaagtgttcattggatgggtgtacctcgtttttaaaaggagaagcaaaatgttatcagcatttgagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagtaagtacctcaactcagcaagcaagctctttccattcttacacactagcggtaattgtgaccctgaataaattacttaacctctcagaccctcaatttcctcatctgtgcaatgtggctacttatacttaaaacataatgtttgtttacttctgaaaaacacagcctaatagtgatatgattattaatgtgattatagatccctatgaagttggtcactggcatcacattcgctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaa

SEQ ID NO: 108750 - DNA, 2635 bp, Homo sapiens
  Payload ID: 1370
  Gene Symbol: ARMC10
  Gene Name: armadillo repeat containing 10
  Uniprot ID: Q8N2F6
  ENST ID: ENST00000323716
  CDS Start-End: 393-1424
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttac

SEQ ID NO: 108751 - DNA, 1581 bp, Homo sapiens
  Payload ID: 1370
  Gene Symbol: ARMC10
  Gene Name: armadillo repeat containing 10
  ENST ID: ENST00000323735
  CDS Start-End: 348-929
cttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagccaaggattacctttagaggaatggagaataagacagaagagggagggacctgaactagccaataagaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgattt

SEQ ID NO: 108752 - DNA, 2445 bp, Homo sapiens
  Payload ID: 1370
  Gene Symbol: ARMC10
  Gene Name: armadillo repeat containing 10
  Uniprot ID: Q8N2F6
  ENST ID: ENST00000428183
  CDS Start-End: 393-1247
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggag

SEQ ID NO: 108753 - DNA, 2443 bp, Homo sapiens
  Payload ID: 1370
  Gene Symbol: ARMC10
  Gene Name: armadillo repeat containing 10
  Uniprot ID: Q8N2F6
  ENST ID: ENST00000425331
  CDS Start-End: 393-1247
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaagggg

SEQ ID NO: 108754 - DNA, 805 bp, Homo sapiens
  Payload ID: 1370
  Gene Symbol: ARMC10
  Gene Name: armadillo repeat containing 10
  ENST ID: ENST00000434153
  CDS Start-End: 106-805
ggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaaatccctatgaagttggtcactggcatcacattcgctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaag

SEQ ID NO: 108755 - DNA, 2347 bp, Homo sapiens
  Payload ID: 1370
  Gene Symbol: ARMC10
  Gene Name: armadillo repeat containing 10
  Uniprot ID: Q8N2F6
  ENST ID: ENST00000454559
  CDS Start-End: 393-1142
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 108756 - DNA, 688 bp, Homo sapiens
  Payload ID: 1370
  Gene Symbol: ARMC10
  Gene Name: armadillo repeat containing 10
  ENST ID: ENST00000431642
  CDS Start-End: 1-558
cgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataa

SEQ ID NO: 108757 - DNA, 2524 bp, Homo sapiens
  Payload ID: 1370
  Gene Symbol: ARMC10
  Gene Name: armadillo repeat containing 10
  Uniprot ID: Q8N2F6
  ENST ID: ENST00000441711
  CDS Start-End: 393-1319
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 108758 - DNA, 2266 bp, Homo sapiens
  Payload ID: 1370
  Gene Symbol: ARMC10
  Gene Name: armadillo repeat containing 10
  Uniprot ID: Q8N2F6
  ENST ID: ENST00000541300
  CDS Start-End: 393-1070
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaagggg

SEQ ID NO: 108759 - DNA, 1667 bp, Homo sapiens
  Payload ID: 1370
  Gene Symbol: ARMC10
  Gene Name: armadillo repeat containing 10
  ENST ID: ENST00000633112
  CDS Start-End: 1-462
gctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 108760 - DNA, 688 bp, Homo sapiens; identical to SEQ ID NO: 108756
  Payload ID: 1370
  Gene Symbol: ARMC10
  Gene Name: armadillo repeat containing 10
  ENST ID: ENST00000631892
  CDS Start-End: 1-558

SEQ ID NO: 108761 - DNA, 1660 bp, Homo sapiens
  Payload ID: 1370
  Gene Symbol: ARMC10
  Gene Name: armadillo repeat containing 10
  ENST ID: ENST00000633975
  CDS Start-End: 1-462
gctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggag

SEQ ID NO: 108762 - DNA, 1844 bp, Homo sapiens
  Payload ID: 1370
  Gene Symbol: ARMC10
  Gene Name: armadillo repeat containing 10
  ENST ID: ENST00000632615
  CDS Start-End: 1-639
gctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 108763 - DNA, 1850 bp, Homo sapiens
  Payload ID: 1370
  Gene Symbol: ARMC10
  Gene Name: armadillo repeat containing 10
  ENST ID: ENST00000632917
  CDS Start-End: 1-639
gctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaacgaaatcctaagctcttgaggccattcacctgccaacctgaccatactgctttcaaaagtcttttctcatcagtagaatctattttggtcacttctagtcaatgaaaaatgtaaacttttaggagagaatgtttcttaggactcacccactccattcaatgttatatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttac

SEQ ID NO: 108764 - DNA, 274 bp, Homo sapiens
  Payload ID: 1370
  Gene Symbol: ARMC10
  Gene Name: armadillo repeat containing 10
  ENST ID: ENST00000631681
  CDS Start-End: 1-274
gctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaag

SEQ ID NO: 108765 - DNA, 841 bp, Homo sapiens
  Payload ID: 1370
  Gene Symbol: ARMC10
  Gene Name: armadillo repeat containing 10
  ENST ID: ENST00000631819
  CDS Start-End: 1-189
gctattattcgtgaattgggtggtattccaattgttgcaaacaaaatcaaccattccaaccagagtattaaagagaaagctttaaatgcactaaataacctgagtgtgaatgttgaaaatcaaatcaagataaagccaaggattacctttagaggaatggagaataagacagaagagggagggacctgaactagccaataagaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgattt

SEQ ID NO: 108766 - DNA, 1169 bp, Homo sapiens
  Payload ID: 1371
  Gene Symbol: ARMC12
  Gene Name: armadillo repeat containing 12
  Uniprot ID: Q5T9G4
  ENST ID: ENST00000288065
  CDS Start-End: 28-1131
acctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgtgagtgtccgggccctggggagagggctctgccccaggaggcacctgctcccgaggcctctgctgtgggagggcccaaaggcctggcagtcgagcgagagcggcacgggcgggactcaggtgagctccggaggctcctcaactctttggagtgcaaacaggatgagtatgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaac

SEQ ID NO: 108767 - DNA, 1254 bp, Homo sapiens
  Payload ID: 1371
  Gene Symbol: ARMC12
  Gene Name: armadillo repeat containing 12
  Uniprot ID: Q5T9G4
  ENST ID: ENST00000373866
  CDS Start-End: 23-1045
ggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgcctggcagtcgagcgagagcggcacgggcgggactcaggtgagctccggaggctcctcaactctttggagtgcaaacaggatgagtatgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccaggttcactccaacttcctaaacctgttccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttgaagtttcttgaagctcgaatgtctgttggtggccttccagggctgggtggagatttcattcagcataacctctgctccagagtgtggtacagcatgggcttatctctcaaaacacatccccacttctatgtttgggggactagctcccctcttctcttgctgcttttc

SEQ ID NO: 108768 - DNA, 1111 bp, Homo sapiens
  Payload ID: 1371
  Gene Symbol: ARMC12
  Gene Name: armadillo repeat containing 12
  Uniprot ID: Q5T9G4
  ENST ID: ENST00000373869
  CDS Start-End: 78-1070
agagttctggttccggaaggccccccacaggtgccttgggcctagctctcacctgggcccagggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgcccgcctggcagtcgagcgagagcggcacgggcgggactcaggtgagctccggaggctcctcaactctttggagtgcaaacaggatgagtatgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctcaaaatccaggaacactccatcaaagtactcgaactgatctccaccatctgggacacggaactgcacattgcgggcctcagactcctcaacaaccttccactgcccgactatgtgcatccacagctgcgacgggtgatgcctgccttgatggagatcctgcagtcagactacatcctggcacaggtgcaagccgtacgactgctgagctacctggcacagaagaatgaccttctctatgacattctcaactgccagcccacacagtcagggagtctcctgtatgaggtactggtgtttgctgagcggctgagtgagggccggaacgcaccccactaccacgtggtgaaatggcattacaacgaacagtccctgcatgaatccctctttggggaagagtcccgactggcagaccgactacttgccctggtcatccaccctgaggaagatgttcagatccaggcctgcaaggtcattgtcagcctgcagtatccccaggacttgagagcccggccctcctcctgccagcccagtcgttcctactttaaaaacacggaataaaattaaggagagccaataaatgagtataggagagaaacttg

SEQ ID NO: 108769 - DNA, 480 bp, Homo sapiens
  Payload ID: 1371
  Gene Symbol: ARMC12
  Gene Name: armadillo repeat containing 12
  ENST ID: ENST00000471400
  CDS Start-End: 18-185
agggcaacactgaagacatgggcaagagcatcccccaatacctggggcaactggacatccgcaaaagcgtagtcagcctggccacaggcgccggggcgatctacctgctctacaaggccatcaaggctggcataaaatgcaaaccacccctctgtagcaactcacccatctgcatcgccccctgaactgggctggggtggctgtctaggcctggcagtcgagcgagagcggcacgggcgggactcaggtgagctccggaggctcctcaactctttggagtgcaaacaggatgagtatgccaagagcatgatcctgcacagtatcactcgctgtgtgtacttgctggaggctgaggcctctgcttgtactacggatgacatcgtgttgctgggctacatgctggatgacaaggacaacagtgtcaaaacccaagctctgaatacacttaaagctttctctggcatcagaaaattcaggctc

SEQ ID NO: 108770 - DNA, 836 bp, Homo sapiens
  Payload ID: 1372
  Gene Symbol: ARMC2
  Gene Name: armadillo repeat containing 2
  ENST ID: ENST00000237512
  CDS Start-End: 169-836
gctggctgcggggcgaagtgggagggtggccgggcggggtgaggatgctgctgcgccctgccctggccgggaccgtggaggagcgggcactgccgtgggtgggggagccgctgtccgagcgggagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatgg

SEQ ID NO: 108771 - DNA, 3663 bp, Homo sapiens
  Payload ID: 1372
  Gene Symbol: ARMC2
  Gene Name: armadillo repeat containing 2
  Uniprot ID: Q8NEN0
  ENST ID: ENST00000368972
  CDS Start-End: 597-2705
aggcccagtggccgagcggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtcttaaaatcttgatttaacaattttggaattgaagtgttcataagttaaatgaactgtgcaatgaaggctgttagattatatagaaagaagggtaggcaacatgagtggaacacgttacaacataggatctgtactaattcttactatgtcaaataataaatgctctcattaggtaccagtatttttttggtctttatattaagagaaggagtaagcagaaaaacttaaagaaaactgctttgggccatctgttctttattaaataagtaaaatagataaaatgagagtatattttcatttgaaataaaatgactggactaagacagtccttctaattgtaactctctgtgtttgacaggtgaggtaatgtattagaaagaatgcaggcttaggtgaatggtatacctgaatctgaatccatgctctcccctgctagctttgtgggcctggagcaagtaacttaatttcttgagctgcaactgcaaaatgggaatcatatcaattttactgtagtgtagtttggaacaaaccattaaatgggcaaatggcccagtccagtgtatcatgtggagtgggtgttcaagaacattatgatggcaagcactttcttagcttgccatcctttgtaggatgagtttggcctttgaataaatgattaaagagc

SEQ ID NO: 108772 - DNA, 3241 bp, Homo sapiens
  Payload ID: 1372
  Gene Symbol: ARMC2
  Gene Name: armadillo repeat containing 2
  Uniprot ID: Q8NEN0
  ENST ID: ENST00000392644
  CDS Start-End: 169-2772
agtggccgagcggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtcttaaaatcttgatttaacaattttggaattgaagtgttcataagttaaatgaactgtgcaatgaaggctgttagattatatagaaagaagggtaggcaacatgagtggaacacgttacaacataggatctgtactaattcttactatgtcaaataataaatgctctcattaggta

SEQ ID NO: 108773 - DNA, 555 bp, Homo sapiens
  Payload ID: 1372
  Gene Symbol: ARMC2
  Gene Name: armadillo repeat containing 2
  ENST ID: ENST00000414610
  CDS Start-End: 1-257
cccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggccctcactgtagattgtggaatgatgactaaggcttgaaagccttactaataaactatcgagtgctcttagtattgttggaatcaaaaataagaaaagagggcttctggttaaaggcacaaaggcattctccagtaatccaatgaaagcagcaaagaatgaaaaacagagaagtaaatttcatcaatgaaacaacaacaaaaaaatggctacgaccctgaactacacaacatgaagcaaactttacactgcagtataggcttgatttttgttggtctgtctagcaaacaggccttctcacattgtgtaataaatgctgctcagtccgta

SEQ ID NO: 108774 - DNA, 2811 bp, Homo sapiens
  Payload ID: 1373
  Gene Symbol: ARMC3
  Gene Name: armadillo repeat containing 3
  Uniprot ID: Q5W041
  ENST ID: ENST00000298032
  CDS Start-End: 85-2703
tagcaacgaggcacaacaagggactgggggttcgtctgctgggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaacaaaaaaaatagttatcattttagtgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtatgtagcagaaaaaatgggtggtaagattccaaaagagaaactacctgatttcagctgggaacttcacataagtgaactgaaatttcaacttaaatccaatgttataccgattggacatgtcaaaaaaggaatcttctaccatcgagctttgcttttcaaggctctggctgatagaattggcattggttgctccctagttcgcggagagtacggtagagcgtggaatgaagtcatgctgcagaatgactctcggaagggagtgattgggggcctccccgctcctgagatgtacgtgattgacctcatgttccatccaggtggactgatgaagttgagaagtcgagaggctgatctttacagattcatttaagccatcagacgaacacaagagaggctcaaacaagaaattcactgtgtacactctctaagacattctccaaattgattttatctctttaaataaaaactttaaataaaa

SEQ ID NO: 108775 - DNA, 3258 bp, Homo sapiens
  Payload ID: 1373
  Gene Symbol: ARMC3
  Gene Name: armadillo repeat containing 3
  ENST ID: ENST00000376528
  CDS Start-End: 385-2214
tagcaacgaggcacaacaagggactgggggttcgtctgctgggtttgcggagcagctagctactcggcgggatctcccggcaggatgggtaaaaagataaagaaggaagtagagcctcctcctaaggatgtggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaacaaaaaaaatagttatcattttagtgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtatgtagcagaaaaaatgggtggtaagattccaaaagagaaactacctgatttcagctgggaacttcacataagtgaactgaaatttcaacttaaatccaatgttataccgattggacatgtcaaaaaaggaatcttctaccatcgagctttgcttttcaaggctctggctgatagaattggcattggttgctccctagttcgcggagagtacggtagagcgtggaatgaagtcatgctgcagaatgactctcggaagggagtgattgggggcctccccgctcctgagatgtacgtgattgacctcatgttccatccaggtggactgatgaagttgagaagtcgagaggctgatctttacagattcatttaagccatcagacgaacacaagagaggctcaaacaagaaattcactgtgtacactctctaagacattctccaaattgattttatctctttaaataaaaactttaaataaaagtattagaaatgttttctctgcgtagaaattaggaagcttggagtgaactttgctgtgcttctgatttcaggcttttggcaagagttctgtcttattaggtcattttccgctcactgaccctcacataaagctgattgttgtcgaaattcatccagcccactgtgtcctgaggagcgtctctgtcatttaggaatcacatgtagcactcagctgctgcacccaggacaacactgtggcctcatgactgtcatctttcatgcccagaatgcttcaggcatgctcagttaagcaaactaagtgaatttttagtatttgcaatcaccttgtctcagtttcatttaagattttgatagtttagatagaataaacacagatctgagtgttacaaattcctttctaaaaatttttgtttctatttttaaaaattcatcattaaaaacactttaatatagtgaattaaaaatatttctaaagtatatttccataaaatggttttggtttcatcttgtctgtgttagcttggaaacataccttcagctaaaaacaattctgatttgctcttccacattttaatgctgggccattaatatattattttcaatttatagaactaaaaaatttttattttttggaaaactttgaagcataaaggtagagcaaatctttgctgaggaattgtgttttagtattgagcacaaaatggggagtaaattcacatttcaaatgataagacaaaaactactaatgtggttaatctcgtgaagtacatattgcctagtcacgcttaaagtccagtgttgacctgtatagtcattttcctagaagacgttttaaagtgaatttgattttagaaattaaagctaagattattttgtattaatttgtaatttcaaataatataattctttatttcagaataaatttatttcaaatgg

SEQ ID NO: 108776 - DNA, 2779 bp, Homo sapiens
  Payload ID: 1373
  Gene Symbol: ARMC3
  Gene Name: armadillo repeat containing 3
  Uniprot ID: Q5W041
  ENST ID: ENST00000409983
  CDS Start-End: 72-2669
caacaagggactgggggttcgtctgctgggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaacaatgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtatgtagcagaaaaaatgggtggtaagattccaaaagagaaactacctgatttcagctgggaacttcacataagtgaactgaaatttcaacttaaatccaatgttataccgattggacatgtcaaaaaaggaatcttctaccatcgagctttgcttttcaaggctctggctgatagaattggcattggttgctccctagttcgcggagagtacggtagagcgtggaatgaagtcatgctgcagaatgactctcggaagggagtgattgggggcctccccgctcctgagatgtacgtgattgacctcatgttccatccaggtggactgatgaagttgagaagtcgagaggctgatctttacagattcatttaagccatcagacgaacacaagagaggctcaaacaagaaattcactgtgtacactctctaagacattctccaaattgattttatctctttaaataaaaactttaaataaaagt

SEQ ID NO: 108777 - DNA, 2479 bp, Homo sapiens
  Payload ID: 1373
  Gene Symbol: ARMC3
  Gene Name: armadillo repeat containing 3
  Uniprot ID: Q5W041
  ENST ID: ENST00000409049
  CDS Start-End: 45-2111
gggtttgcggagcagctagctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaacaaaaaaaatagttatcattttagtgctggatttggatctcccatagaagacaaatcagagccagcttctggacgaaatactgttctcagcaaaagcgccaccaaagaaaaaggatggagctcactccccacttcaagataaaccctgaagcactcctaggatttaagaggattgttggcatgaggagaacacagagactttggattcagacacaactgggccttggtcttctgaattgtaaatgaaaatgatgatccctgcctcaaagagctgctgtaagaggagagatggtgtcaggaaagtgcctgaccatcacctagcacacttaggggctcaatgtgcgtcccttctctcttcccttcttagcctttggtccattgaggggtagattagccatagccctgttgtcctgttgcctgtcttttggtcaacccttcttgtcttatgactattaaaactttggactcctggaaatagaataaaatattttaactgcattcgtctgaaaa

SEQ ID NO: 108778 - DNA, 525 bp, Homo sapiens
  Payload ID: 1373
  Gene Symbol: ARMC3
  Gene Name: armadillo repeat containing 3
  ENST ID: ENST00000447081
  CDS Start-End: 170-525
actcggcgggatctcccggcaggatgggtaaaaagataaagaaggaagtagagcctcctcctaaggatgtggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgat

SEQ ID NO: 108779 - DNA, 3572 bp, Homo sapiens
  Payload ID: 1374
  Gene Symbol: ARMC4
  Gene Name: armadillo repeat containing 4
  Uniprot ID: Q5T2S8
  ENST ID: ENST00000305242
  CDS Start-End: 94-3228
atacggtgcaacgggtccgcgggaatcttggatgcgcggaggtcccgagaccaggtgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagggaggaaatcaaacagctacagtgattgcgttgtgttcaatgagggatttcagcttagctcaagaaacctgccagttggccatcagagatgttggaggcctggaagtgctgataaatttgcttgaaaccgatgaagtcaaatgtaagattggttcattaaaaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggttgctctactagactgtgcacatgattccacaaaacctgcccaatcgagtctgtatgaggccagagacgtggaagtggctcgctgtggggcactggccctgtggagctgcagtaagagtcatacgaataaagaagccatccgcaaagctgggggcattcctctgttggctcggctgctgaagacttctcatgaaaacatgctaattccagtggtggggacattgcaagagtgtgcatcagaggaaaactaccgggctgcaatcaaagcagaaaggatcattgaaaaccttgtcaagaacctaaatagtgagaatgagcagctgcaggagcactgcgccatggccatttaccagtgtgctgaagataaggaaacccgggacctcgttaggctgcacggaggacttaagcccttggccagtctactcaataacactgacaataaagagcggttagctgctgtcacaggggctatatggaaatgttccatcagcaaagagaatgttaccaagtttcgggaatacaaagccattgaaaccttggtgggacttctaacagatcagcctgaagaagtacttgtgaatgtggttggggccttgggagaatgctgccaagaacgtgaaaaccgagtcattgtccggaaatgtggtggcattcaaccacttgtgaacctccttgttggaataaaccaagctcttcttgtgaatgttacaaaagcagttggtgcttgtgcagtagaacctgaaagtatgatgataattgatcgcttagatggagttcgtttgttgtggtccctgctgaaaaatcctcacccagacgtgaaggccagcgcagcatgggcactctgtccatgcatcaaaaatgcaaaggatgctggggaaatggttcgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaaattgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaaaggatatggccttcccaa

SEQ ID NO: 108780 - DNA, 1737 bp, Homo sapiens
  Payload ID: 1374
  Gene Symbol: ARMC4
  Gene Name: armadillo repeat containing 4
  ENST ID: ENST00000434029
  CDS Start-End: 1-1170
ctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagcaaaaggaaacaagtcaaaatggcagaaacaaaagatggatcaggaagcagaataccagagtaattagaagcatgatctttgacgttggaaagaccagttgagttgaaattctgccgcttactcaatggccttgggtgatgatgctgtaccctaattctaaaggaagcaatgaacccccttttcagctaccttactgataagcacttatgttctgccttctgctatcctgatggttcaggttgtctgtcttactatctacttcttgagtagagagaccacattaaatttattgctgtatctcgcagggcatcttgctagtgtgcacaggctcgcctccctacctctgccccgatggtgtgaaggggagagggcgaggttccttagtggcagggctttgctgttcttcactctcagccccctgaaagcagttcttcctgcctctgagcctgtctttccttctgctgttaacttctttcctacttttcttgcatccctctctcttccttttcctgccgtctttcttgtagacatactagttgattgctgtatttgctgactttatatggatattattttttcctctggccaaaattgttttaaaatcttgcaaggaaaatgtcttgcttttgatcacttccagagattaaaggagatggtttgttaatgtc

SEQ ID NO: 108781 - DNA, 308 bp, Homo sapiens
  Payload ID: 1374
  Gene Symbol: ARMC4
  Gene Name: armadillo repeat containing 4
  ENST ID: ENST00000486279
  CDS Start-End: 138-308
ggtccttcaagaagttactatatgaatgcacttggggaaaccagagctaccagaatcatgttcttcagtcatcattgtgatgatgcagatattgtcacttgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccactt

SEQ ID NO: 108782 - DNA, 3612 bp, Homo sapiens
  Payload ID: 1375
  Gene Symbol: ARMC5
  Gene Name: armadillo repeat containing 5
  Uniprot ID: Q96C12
  ENST ID: ENST00000268314
  CDS Start-End: 530-3337
tcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttgg

SEQ ID NO: 108783 - DNA, 3626 bp, Homo sapiens
  Payload ID: 1375
  Gene Symbol: ARMC5
  Gene Name: armadillo repeat containing 5
  ENST ID: ENST00000408912
  CDS Start-End: 318-3410
ggatgggcaggtgggagctgtggccgaaggtctggccacactcaccaccaagcatcaggtttccggactttgtgactgtgctggtgccgcagcagattccaactgtgcacaaaactcttactacaaacaaggcacttagaggccttctcacccatgtggagcgcaggtgctgcaacagggtggagccaaggctgagactcttgccgcagtcccctcagcggtaaggcttttagcggtgtgagcgcgctggtgctggatcaggttggagctgacgctgaaagtcttaccacactaggcacaggcatagggccgaagcgatggtcacactcggggcaggagtacggcttttcaccggtgtgtacccagtggtgcttaaccagatcagagccacatcggaagcttctgccataacccggacaacgatgccagctcctgagctcacgagcacgtccagagcggaggacactcgggacaccggggtccagctccggaaacggaaaattccacaagcccgtcactctaggaagcggcagcgaacgttctcgttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagag

SEQ ID NO: 108784 - DNA, 4844 bp, Homo sapiens
  Payload ID: 1375
  Gene Symbol: ARMC5
  Gene Name: armadillo repeat containing 5
  Uniprot ID: Q96C12
  ENST ID: ENST00000457010
  CDS Start-End: 702-2879
gctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggat

SEQ ID NO: 108785 - DNA, 3017 bp, Homo sapiens
  Payload ID: 1375
  Gene Symbol: ARMC5
  Gene Name: armadillo repeat containing 5
  Uniprot ID: Q96C12
  ENST ID: ENST00000538189
  CDS Start-End: 427-2742
ccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttgg

SEQ ID NO: 108786 - DNA, 586 bp, Homo sapiens
  Payload ID: 1375
  Gene Symbol: ARMC5
  Gene Name: armadillo repeat containing 5
  ENST ID: ENST00000564514
  CDS Start-End: 1-32
ctttgggtaagtgctccgcccccgtttcctagaaagattaggtttgcaactcccttgctctctagacccgggcagtctggagttctttgtgtcctatcccggaataacgtgctttgtgatggcgcatcgctcctgtttctcaatctgttgtgccccgtgacgtcactgcactctctatagatgagagagagccctcccagaccagataattgtagccattatctaggaattggttgttgaggacttctttcgaagctggactagcggaggccaaagagttatttgtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgt

SEQ ID NO: 108787 - DNA, 2072 bp, Homo sapiens
  Payload ID: 1375
  Gene Symbol: ARMC5
  Gene Name: armadillo repeat containing 5
  ENST ID: ENST00000564900
  CDS Start-End: 1-1796
ggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttgga

SEQ ID NO: 108788 - DNA, 3549 bp, Homo sapiens
  Payload ID: 1375
  Gene Symbol: ARMC5
  Gene Name: armadillo repeat containing 5
  Uniprot ID: Q96C12
  ENST ID: ENST00000563544
  CDS Start-End: 547-3354
agatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttggtgaccattcttcagtgcatgaagacagacagcatccagaaccgaacggcccgtgccctggggaacttagccatggaacctgagagctgtggggacatccactgtgctggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggggagaggctactgcagaacctgacggttcaggctgagtcgccctttggggttggggccctgacgcacctgctgctctctgggagccctgaggaccgagtggcctgcgcgctgaccctgcccttcatctgccggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggccca

SEQ ID NO: 108789 - DNA, 2412 bp, Homo sapiens
  Payload ID: 1376
  Gene Symbol: ARMC6
  Gene Name: armadillo repeat containing 6
  Uniprot ID: Q6NXE6
  ENST ID: ENST00000269932
  CDS Start-End: 451-1881
ggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaaga

SEQ ID NO: 108790 - DNA, 2383 bp, Homo sapiens
  Payload ID: 1376
  Gene Symbol: ARMC6
  Gene Name: armadillo repeat containing 6
  Uniprot ID: Q6NXE6
  ENST ID: ENST00000392335
  CDS Start-End: 403-1833
gagtcctggtgcgcaggcgcgggccgccgcggcccggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaacagcgga

SEQ ID NO: 108791 - DNA, 1866 bp, Homo sapiens
  Payload ID: 1376
  Gene Symbol: ARMC6
  Gene Name: armadillo repeat containing 6
  Uniprot ID: Q6NXE6
  ENST ID: ENST00000392336
  CDS Start-End: 108-1613
ttttcattcattttatttattcattcagcacctgtgcactgagtgcctgctgcgtgtcgggccccgtcctaggcagtggggacaaggaggctacagggtacaaataaatgagtgaacgatgttgctctagatacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctcctt

SEQ ID NO: 108792 - DNA, 622 bp, Homo sapiens
  Payload ID: 1376
  Gene Symbol: ARMC6
  Gene Name: armadillo repeat containing 6
  ENST ID: ENST00000535288
  CDS Start-End: 154-622
aggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatga

SEQ ID NO: 108793 - DNA, 552 bp, Homo sapiens
  Payload ID: 1376
  Gene Symbol: ARMC6
  Gene Name: armadillo repeat containing 6
  ENST ID: ENST00000538663
  CDS Start-End: 242-552
acgtggccgcgaagaccgggtgagacgctgcggctgccgaggcctgtcccgcgcggagtggggagtgggggtgccgcagggtcgggctggcgcgaccctcggagacggggccttactatgttgtccttgctggtctcaaactccagacttgaaacagtcctcccaccttggcctcctaaagcactgggatcacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgctt

SEQ ID NO: 108794 - DNA, 537 bp, Homo sapiens
  Payload ID: 1376
  Gene Symbol: ARMC6
  Gene Name: armadillo repeat containing 6
  ENST ID: ENST00000543877
  CDS Start-End: 347-537
aaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacagagacggggccttactatgttgtccttgctggtctcaaactccagacttgaaacagtcctcccaccttggcctcctaaagcactgggatcacagctcaggagcatctatcggctgcacgccaacatcaacacaggcgaagatggtctccaagcgcattgccca

SEQ ID NO: 108795 - DNA, 563 bp, Homo sapiens
  Payload ID: 1376
  Gene Symbol: ARMC6
  Gene Name: armadillo repeat containing 6
  ENST ID: ENST00000536098
  CDS Start-End: 352-563
gcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcag

SEQ ID NO: 108796 - DNA, 951 bp, Homo sapiens
  Payload ID: 1376
  Gene Symbol: ARMC6
  Gene Name: armadillo repeat containing 6
  ENST ID: ENST00000540792
  CDS Start-End: 467-951
ctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgaccca

SEQ ID NO: 108797 - DNA, 1252 bp, Homo sapiens
  Payload ID: 1376
  Gene Symbol: ARMC6
  Gene Name: armadillo repeat containing 6
  ENST ID: ENST00000539985
  CDS Start-End: 371-514
cttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacagagatggagtttcgccacgtgtccaggctggtctcaaactcctggcctcatgtgatccttccgcctcggcctcccaaagtgcaggccaccatgcctggcctgaagtggaaacttgataattccagaacggaaacttgatattactgcaataagcaagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcc

SEQ ID NO: 108798 - DNA, 1318 bp, Homo sapiens
  Payload ID: 1376
  Gene Symbol: ARMC6
  Gene Name: armadillo repeat containing 6
  ENST ID: ENST00000537263
  CDS Start-End: 549-1318
gcgcaggcgcgggccgccgcggcccggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggagatggagtttcgccacgtgtccaggctggtctcaaactcctggcctcatgtgatccttccgcctcggcctcccaaagtgcaggccaccatgcctggcctgaagtggaaacttgataattccagaacggaaacttgatattactgcaataagcaagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagc

SEQ ID NO: 108799 - DNA, 557 bp, Homo sapiens
  Payload ID: 1376
  Gene Symbol: ARMC6
  Gene Name: armadillo repeat containing 6
  ENST ID: ENST00000540707
  CDS Start-End: 468-557
gcggcccggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggagacggggccttactatgttgtccttgctggtctcaaactccagacttgaaacagtcctcccaccttggcctcctaaagcactgggatcacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtg

SEQ ID NO: 108800 - DNA, 1320 bp, Homo sapiens
  Payload ID: 1376
  Gene Symbol: ARMC6
  Gene Name: armadillo repeat containing 6
  ENST ID: ENST00000540634
  CDS Start-End: 1-244
gaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggcccccagcttccgtggaatccagccgatgcaaacagctgaggagcgtcaccctggctgcacctctccgtggtgtccccgtctcccctgcccccagcaggaaagggtgctctcagctcagcagggctggcccaaacctctgacccagtcaccccgccctatccctcctccctggagactcccaggatgtgggagaaagatctcgaatctgccccagactgccctgacttaacttctgggccagtgtgaccttgggcagttctcaagcatttcttcatctgtcatgtggcggggtaggtgctcctgagctatttcgaggacggcctgcagtgctggccctgtcattcctgctccagccttgctctcagtctgcccatggctcccctttgccttctacataaaaccaaacctgtctgtggtcccagcaacttgggctaaggcgggaagatcacttgagcccaggagtcaaggctgcagtgagttaggatggcaccactgcactccagcctgggtgacggatcaagagcttgtctcaaaaacaaacaaacaaacaaaaaaatgcacttcatgccctgcagacccagtatggcccaggccttgcccatttcccagtctttccactgtactcactccctattcccccaccccagggcctttgcacaagcccccatgtgacaagccatgccctctgcctagaagtgcccttcccttggccttccccgtggccggctcctcctagcacatgaggtttcagctcacgttgccttctccaggagagacccccatctcatcacctcatgtgctctggctctgacactgggccccatctgaggtcacctcatttgtgaactctcctgtttgtcttgcccccaccatcggctggctccctgcagggaggcccctgtccccacttgctgtgccttcagcttcccgtcagtgtttttgagtgttcacctgaataaactgacaagcactcgaggtccctgccaggtggccccagcgtcctcccctgggcctgggccaagctgcaggcttcttcaggaaggg

SEQ ID NO: 108801 - DNA, 2488 bp, Homo sapiens
  Payload ID: 1376
  Gene Symbol: ARMC6
  Gene Name: armadillo repeat containing 6
  Uniprot ID: Q6NXE6
  ENST ID: ENST00000535612
  CDS Start-End: 433-1938
tcctggtgcgcaggcgcgggccgccgcggcccggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaacagcgga

SEQ ID NO: 108802 - DNA, 1052 bp, Homo sapiens
  Payload ID: 1376
  Gene Symbol: ARMC6
  Gene Name: armadillo repeat containing 6
  ENST ID: ENST00000535795
  CDS Start-End: 1-412
gagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcaggtgggcagggcaggggatgggggcaggcaggctggtgtgggatgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggcca

SEQ ID NO: 108803 - DNA, 1079 bp, Homo sapiens
  Payload ID: 1376
  Gene Symbol: ARMC6
  Gene Name: armadillo repeat containing 6
  ENST ID: ENST00000545091
  CDS Start-End: 155-286
aggggcgccacagcgcctgcgcgcgtacggcggccggaaggggctagaggcggctccctgggtgacaaccgcgcgccccacctttccccacgtggccgcgaagaccggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaa

SEQ ID NO: 108804 - DNA, 1814 bp, Homo sapiens
  Payload ID: 1376
  Gene Symbol: ARMC6
  Gene Name: armadillo repeat containing 6
  ENST ID: ENST00000546344
  CDS Start-End: 319-1545
tctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctggcaggcccccagcttccgtggaatccagccgatgcaaacagctgaggagcgtcaccctggctgcacctctccgtggtgtccccgtctcccctgcccccagcaggaaagggtgctctcagctcagcagggctggcccaaacctctgacccagtcaccccgccctatccctcctccctggagactcccaggatgtgggagaaagatctcgaatctgccccagactgccctgacttaacttct

SEQ ID NO: 108805 - DNA, 505 bp, Homo sapiens
  Payload ID: 1376
  Gene Symbol: ARMC6
  Gene Name: armadillo repeat containing 6
  ENST ID: ENST00000535758
  CDS Start-End: 10-222
tacaaataaatgagtgaacgatgttgctctagatacagccaggctggagtgcaatggcatgatctcggctcactgcaacctccgcctctgtgctcaagtggttctcctacctcggtctccctgattgctgggattacagacctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcg

SEQ ID NO: 108806 - DNA, 1198 bp, Homo sapiens
  Payload ID: 1376
  Gene Symbol: ARMC6
  Gene Name: armadillo repeat containing 6
  ENST ID: ENST00000541898
  CDS Start-End: 421-1198
cgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcgggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaag

SEQ ID NO: 108807 - DNA, 560 bp, Homo sapiens
  Payload ID: 1376
  Gene Symbol: ARMC6
  Gene Name: armadillo repeat containing 6
  ENST ID: ENST00000541725
  CDS Start-End: 71-560
ggctctcttgcgcaagcgcgctgtccgcttcttctgggcggacgctctggaggctacagggtacaaataaatgagtgaacgatgttgctctagatacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcgg

SEQ ID NO: 108808 - DNA, 762 bp, Homo sapiens
  Payload ID: 1376
  Gene Symbol: ARMC6
  Gene Name: armadillo repeat containing 6
  ENST ID: ENST00000535478
  CDS Start-End: 1-436
ggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggc

SEQ ID NO: 108809 - DNA, 2126 bp, Homo sapiens
  Payload ID: 1377
  Gene Symbol: ARMC7
  Gene Name: armadillo repeat containing 7
  Uniprot ID: Q9H6L4
  ENST ID: ENST00000245543
  CDS Start-End: 303-899
cggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggagaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaagccaaggtcttttattaaaggtcccgactggt

SEQ ID NO: 108810 - DNA, 1204 bp, Homo sapiens
  Payload ID: 1377
  Gene Symbol: ARMC7
  Gene Name: armadillo repeat containing 7
  ENST ID: ENST00000582136
  CDS Start-End: 312-560
cccaggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattgctgctgcagtctgaacggtgacggtggcccctgcagaagcatgtggctaaatctccaccagggggcgatagagctcctccaaatcaagctgctgcccctggagaaaaattggcggaagtcacagagcagtccccaccaaaagtgtttaccaagtggagtctttcctgctggcgtttcctcagggtcaggaagcaactttcccaggacaggggcaccctgaggtccgggtccactgagctatgggggcggcgtgggcctgggctgggttcttgccatcctgggcagcttcccggcgtgggtgactgagcccgggtcctggagtccgcggtcccagcgtctccacttctcagctgattcctagaagctgagtcccgtcccttctccgagcgtggtttcctctcccgccttgcctgcgtcgcaagcagttgtgggagcagaagtgtgtctgtgcatctgtgtctctgtgcaggtattttagaattgttaggatcattatcaccagctttacttttcccaaccatttttttcctcctttttttctcttccttcttctgccacagcaagacccccccgccccaagcacagtagctttctcagcgtcgaatccctccgtgggaccatgttgcaatgaaatttcaacatgcaaatgaaatttctc

SEQ ID NO: 108811 - DNA, 445 bp, Homo sapiens
  Payload ID: 1377
  Gene Symbol: ARMC7
  Gene Name: armadillo repeat containing 7
  ENST ID: ENST00000584947
  CDS Start-End: 109-414
tcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattgcaagacccccccgccccaagcacagtagctttctcagcgtcgaatccctccgtgggaccatgttgcaatgaaatttcaacatgcaaatgaaatttctcgaaa

SEQ ID NO: 108812 - DNA, 1002 bp, Homo sapiens
  Payload ID: 1377
  Gene Symbol: ARMC7
  Gene Name: armadillo repeat containing 7
  Uniprot ID: Q9H6L4
  ENST ID: ENST00000581078
  CDS Start-End: 338-649
gcttccgccgggagcccggaaccgagcccaggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggagaccacagtcctgatgtggacgcagggaacggggagcacatactgccccattggtgccttttcagccatctgaaaggcgggttctttcagca

SEQ ID NO: 108813 - DNA, 3181 bp, Homo sapiens
  Payload ID: 1378
  Gene Symbol: ARMC8
  Gene Name: armadillo repeat containing 8
  Uniprot ID: Q8IUR7
  ENST ID: ENST00000358441
  CDS Start-End: 386-1543
gagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattattaatta

SEQ ID NO: 108814 - DNA, 1920 bp, Homo sapiens
  Payload ID: 1378
  Gene Symbol: ARMC8
  Gene Name: armadillo repeat containing 8
  ENST ID: ENST00000485396
  CDS Start-End: 77-1879
tgcagcagccgggtgggaaggctcaagatggcgtgcttgttggagaccccaatccgcatgagcgtcctttcgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttg

SEQ ID NO: 108815 - DNA, 2777 bp, Homo sapiens
  Payload ID: 1378
  Gene Symbol: ARMC8
  Gene Name: armadillo repeat containing 8
  Uniprot ID: Q8IUR7
  ENST ID: ENST00000491704
  CDS Start-End: 380-2275
gcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaatta

SEQ ID NO: 108816 - DNA, 1059 bp, Homo sapiens
  Payload ID: 1378
  Gene Symbol: ARMC8
  Gene Name: armadillo repeat containing 8
  ENST ID: ENST00000463485
  CDS Start-End: 4-1059
aagatggcgtgcttgttggagaccccaatccgcatgagcgtcctttcgagacatgaaaaatgctgtaattggaaacaacaagcagaaagccaatctcattgttttaggagctgttccaaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttct

SEQ ID NO: 108817 - DNA, 612 bp, Homo sapiens
  Payload ID: 1378
  Gene Symbol: ARMC8
  Gene Name: armadillo repeat containing 8
  ENST ID: ENST00000464181
  CDS Start-End: 1-271
attgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggagcccaaactggacatctccttaaaagtgttggcagttagaagaagaaagaatcactagccatagaattctactggaggaagccacatccatttctttgtctctgcttagttgaaatatagtcctacatgagaagataagtctgtcttagccttgaaaaaaccattgagcatattttgccattgatactctctcagatgtgcataaattatttgaacatactagaaattttttttattgaccaataggacaatcatctataaagtttattttattattgagtcctttttcattcaggcgaaaacaccctatccaaagcaaccagaaatggttgtactttcagtacataaagcaaaataaataagaattgtatttagaagaa

SEQ ID NO: 108818 - DNA, 807 bp, Homo sapiens
  Payload ID: 1378
  Gene Symbol: ARMC8
  Gene Name: armadillo repeat containing 8
  ENST ID: ENST00000466749
  CDS Start-End: 417-807
aggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcac

SEQ ID NO: 108819 - DNA, 731 bp, Homo sapiens
  Payload ID: 1378
  Gene Symbol: ARMC8
  Gene Name: armadillo repeat containing 8
  ENST ID: ENST00000461600
  CDS Start-End: 137-731
ccacctctaacccaggctcagagtagctgctgtttctgagagaacgattccggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacct

SEQ ID NO: 108820 - DNA, 1656 bp, Homo sapiens
  Payload ID: 1378
  Gene Symbol: ARMC8
  Gene Name: armadillo repeat containing 8
  ENST ID: ENST00000470821
  CDS Start-End: 25-1224
agcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgat

SEQ ID NO: 108821 - DNA, 1714 bp, Homo sapiens
  Payload ID: 1378
  Gene Symbol: ARMC8
  Gene Name: armadillo repeat containing 8
  ENST ID: ENST00000489213
  CDS Start-End: 255-1328
gattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgatttttt

SEQ ID NO: 108822 - DNA, 829 bp, Homo sapiens
  Payload ID: 1378
  Gene Symbol: ARMC8
  Gene Name: armadillo repeat containing 8
  ENST ID: ENST00000468560
  CDS Start-End: 753-829
gcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaaaagggggtgagatttatttccccattgttgaaagaagggaacgtattgacatgccaggaagtaaaacctgttttttttttttttaaaaaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgt

SEQ ID NO: 108823 - DNA, 4790 bp, Homo sapiens
  Payload ID: 1378
  Gene Symbol: ARMC8
  Gene Name: armadillo repeat containing 8
  Uniprot ID: Q8IUR7
  ENST ID: ENST00000469044
  CDS Start-End: 272-2293
tgcggaaaccgctgcccgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaa

SEQ ID NO: 108824 - DNA, 774 bp, Homo sapiens
  Payload ID: 1378
  Gene Symbol: ARMC8
  Gene Name: armadillo repeat containing 8
  ENST ID: ENST00000469860
  CDS Start-End: 1-341
gactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaacttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatg

SEQ ID NO: 108825 - DNA, 652 bp, Homo sapiens
  Payload ID: 1378
  Gene Symbol: ARMC8
  Gene Name: armadillo repeat containing 8
  ENST ID: ENST00000470549
  CDS Start-End: 1-353
gactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgtttaacttacatgtgtagagctggagcaattcggacagatgataactgtattgtattaaagcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatg

SEQ ID NO: 108826 - DNA, 3043 bp, Homo sapiens
  Payload ID: 1378
  Gene Symbol: ARMC8
  Gene Name: armadillo repeat containing 8
  Uniprot ID: Q8IUR7
  ENST ID: ENST00000481646
  CDS Start-End: 407-2386
cagatcttctttgcgcatgcggaaaccgctgcccgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaa

SEQ ID NO: 108827 - DNA, 2910 bp, Homo sapiens
  Payload ID: 1378
  Gene Symbol: ARMC8
  Gene Name: armadillo repeat containing 8
  Uniprot ID: Q8IUR7
  ENST ID: ENST00000471453
  CDS Start-End: 145-1302
gcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagcctagtctaacactgaactcatgttcttgatgagaatacttctagatgaggagtatagtggtaagtaagctctgacttggctccttccacaaaccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgac

SEQ ID NO: 108828 - DNA, 2221 bp, Homo sapiens
  Payload ID: 1378
  Gene Symbol: ARMC8
  Gene Name: armadillo repeat containing 8
  Uniprot ID: Q8IUR7
  ENST ID: ENST00000461822
  CDS Start-End: 39-1859
gcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacg

SEQ ID NO: 108829 - DNA, 691 bp, Homo sapiens
  Payload ID: 1378
  Gene Symbol: ARMC8
  Gene Name: armadillo repeat containing 8
  ENST ID: ENST00000471709
  CDS Start-End: 9-691
ggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatg

SEQ ID NO: 108830 - DNA, 4728 bp, Homo sapiens
  Payload ID: 1378
  Gene Symbol: ARMC8
  Gene Name: armadillo repeat containing 8
  Uniprot ID: Q8IUR7
  ENST ID: ENST00000538260
  CDS Start-End: 308-2236
gagcggcaggtggggccggcagatcttctttgcgcatgcggaaaccgctgcccgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttct

SEQ ID NO: 108831 - DNA, 2300 bp, Homo sapiens
  Payload ID: 1379
  Gene Symbol: ARMC9
  Gene Name: armadillo repeat containing 9
  Uniprot ID: Q7Z3E5
  ENST ID: ENST00000349938
  CDS Start-End: 195-2192
tccctcccaggctgctccgcgtcggcggcgccccgcgcgattggctgcgccgcccccacgtgacgccggggtggcggcggcggttgcccgggtgacggctgcggaggtggcggccgggctgggatagcgcgagtgtccgcggccgagcagcagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttgataaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagca

SEQ ID NO: 108832 - DNA, 729 bp, Homo sapiens
  Payload ID: 1379
  Gene Symbol: ARMC9
  Gene Name: armadillo repeat containing 9
  ENST ID: ENST00000440107
  CDS Start-End: 231-729
gggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactct

SEQ ID NO: 108833 - DNA, 1050 bp, Homo sapiens
  Payload ID: 1379
  Gene Symbol: ARMC9
  Gene Name: armadillo repeat containing 9
  ENST ID: ENST00000428662
  CDS Start-End: 1-517
gaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatggtcccctgaaggagtgactgcggttgtgcccattttgctgctgacaacatcaaggctgaaagggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagca

SEQ ID NO: 108834 - DNA, 626 bp, Homo sapiens
  Payload ID: 1379
  Gene Symbol: ARMC9
  Gene Name: armadillo repeat containing 9
  ENST ID: ENST00000436339
  CDS Start-End: 1-626
tctctagaggccacagtcagcggcaagatggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagg

SEQ ID NO: 108835 - DNA, 257 bp, Homo sapiens
  Payload ID: 1379
  Gene Symbol: ARMC9
  Gene Name: armadillo repeat containing 9
  ENST ID: ENST00000444285
  CDS Start-End: 1-222
gagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggtgaggctctgcgctcagggcagggtgcccgtggtctatccccccaaatttaaaaagaatgtaactttaaaaatagcatgaaaaaataacatgcaagaggctgcatttaagctggc

SEQ ID NO: 108836 - DNA, 599 bp, Homo sapiens
  Payload ID: 1379
  Gene Symbol: ARMC9
  Gene Name: armadillo repeat containing 9
  ENST ID: ENST00000446447
  CDS Start-End: 125-599
agtcccacttccagaattgtggcgttatcgtttctcgtgctgttctctctgtccttgggaattatcttttttaacagtccatttattgtagttttactgtggcttagagggagccaaattagtcatgtgtcttggatctgccattctaacctggaaaacagccgcaacgaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatg

SEQ ID NO: 108837 - DNA, 582 bp, Homo sapiens
  Payload ID: 1379
  Gene Symbol: ARMC9
  Gene Name: armadillo repeat containing 9
  ENST ID: ENST00000424740
  CDS Start-End: 1-582
ttgaacttgtgttgctgagtaggaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacag

SEQ ID NO: 108838 - DNA, 4975 bp, Homo sapiens
  Payload ID: 1379
  Gene Symbol: ARMC9
  Gene Name: armadillo repeat containing 9
  ENST ID: ENST00000614261
  CDS Start-End: 159-2615
gcgcgattggctgcgccgcccccacgtgacgccggggtggcggcggcggttgcccgggtgacggctgcggaggtggcggccgggctgggatagcgcgagtgtccgcggccgagcagcagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttgataaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtggtggaagaccaacacacacctccccagacagcccagcacgccagaaacggccacccgcaggccctgccagccgctcacgaggctgtctacagggagggcaagcccagcaccccggagtcctgcgtctcctcttcatcagccatcatcgccaagccaggagagtggctcccaagaggacgccaggaagagcctcgcccagcccccacggggaccccccgccagccaagggaggcgccccaggacccaggcaatggagtgaccaccagggaatgtgcatcagccttcacctgcaagccccgggccccctgcactccagagatgctggactggaacccacccaaggcaaaggcgtcagttctggcccctctgttctcttcgtgtggcccccagcaggccagccgccccggctccacagcgtcctccacaaggggcctgccgagcagccagtctcacaggaagtaaggatgtccccgggtgtccccatcacgttgccggaggaccagccagcttcccgctctcagctggcagcagctgccggtgatggatgtgaagggacagttgtccacaagactctgggagctgaggggaggccggctctccaggcagcaccagagcaaggccatcgcagccccgccagccgggtcactttctcccagggcagagccaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtc

SEQ ID NO: 108839 - DNA, 5759 bp, Homo sapiens
  Payload ID: 1379
  Gene Symbol: ARMC9
  Gene Name: armadillo repeat containing 9
  ENST ID: ENST00000611582
  CDS Start-End: 1-2457
atgggggacattctggctcatgaatctgaattacttggactagtgaaagagtatttagattttgctgaatttgaagacaccttgaaaacattttcaaaagaatgcaaaataaaaggaaaaccattgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttgataaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagctcggagaactctcaggagagaagcttctgaccacggagtacctggggatcatgaccaacacggggaagacaaggcggaaggggctggctaatgtgcagtggagcggggatgagcccctgcaaaggcccgtcacccccggcggccacagaaacgggtacccagtggtggaagaccaacacacacctccccagacagcccagcacgccagaaacggccacccgcaggccctgccagccgctcacgaggctgtctacagggagggcaagcccagcaccccggagtcctgcgtctcctcttcatcagccatcatcgccaagccaggagagtggctcccaagaggacgccaggaagagcctcgcccagcccccacggggaccccccgccagccaagggaggcgccccaggacccaggcaatggagtgaccaccagggaatgtgcatcagccttcacctgcaagccccgggccccctgcactccagagatgctggactggaacccacccaaggcaaaggcgtcagttctggcccctctgttctcttcgtgtggcccccagcaggccagccgccccggctccacagcgtcctccacaaggggcctgccgagcagccagtctcacaggaagtaaggatgtccccgggtgtccccatcacgttgccggaggaccagccagcttcccgctctcagctggcagcagctgccggtgatggatgtgaagggacagttgtccacaagactctgggagctgaggggaggccggctctccaggcagcaccagagcaaggccatcgcagccccgccagccgggtcactttctcccagggcagagccaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtcaaaaaaaaaaaaaaaatacattgagattaccaggtggggtatgtgtggttcttccaggaaagtgctgaaaatatcacccaggcctctgcgccacgccctgggagagtacactcctgggctcacgcctctgcattccaaggctgacagctagaaatatactttgtaaaataccaacaacttattcacaaatattccaactatctaccagctccaatgagcttgctgaggatgggtatgaccccagtctaaggggaaagaatctaaaacacaagtaaacctgtttaaaggccagatctccagatggagatccaagcagatggcgcctaaggtttgcccttgaaaactaccaaggaagccacagagagggatctttggaccttctggaaaatggtaaggccccaggtagattatggctcctctgccctggaggctgagccgcccctctggttacctcacatcttctggtttcttctgagtgggacttgatctcatttctgcattcacagcaaggtggaactgtctggcaagagcttaaattaggacctgtggtggggactttaataggcaggtggaggtttgagatccagtgagatgccagagattagtcaataggtgaggaaagatttggcccaaatcaaaagagctaaaaaaaaaataataaaataaaaataaaaataaaatagttgaacaaataaggttcatgaaaaaaaaagaaaagaaagaaaaggtaaagaaaagaaatccatgataaaatatcaaactttttaataaaaacaagtctggccctgtacttggatgaccccacctggcttgtctaaccctaatcccagccccagttttaataaaactgtatttacaaaataggcagctgggacgtggaccagagataccaatttgattttttttaaatattacattaaaatattacatcatgtgtcttca

SEQ ID NO: 108840 - DNA, 2141 bp, Homo sapiens
  Payload ID: 1380
  Gene Symbol: ARMCX1
  Gene Name: armadillo repeat containing, X-linked 1
  Uniprot ID: Q9P291
  ENST ID: ENST00000372829
  CDS Start-End: 372-1733
gccgacgcgtgcagacgtccttctaatcctagtcttcgtttggtccggttgcactcttcctatagcccagagggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagcagaaaaaaaaaa

SEQ ID NO: 108841 - DNA, 2053 bp, Homo sapiens
  Payload ID: 1380
  Gene Symbol: ARMCX1
  Gene Name: armadillo repeat containing, X-linked 1
  ENST ID: ENST00000616751
  CDS Start-End: 301-1398
gggcgagagggcctgtggcctgggggaaggaggacgaggttctgcctggatcccagcagtaggacgctgtgccatttgggaacaaaggaatagtctgcctggaatccctgcagatcttggggccggaggccagtccaacccttggagcaggaagaaacgcaaagttgtcaagaaccaagtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacagctggtcagttgtaaagtaccatcagaattgatttccctctttaataaagaatgggatagagagattcttcttaatatccttaccctatttgagaatataaatgacaacataaaaaatgaagggctcgcatcatccaggaaagaattcagcagaagttcactttttttcttattcaaagagtctggagtttgtgttaagaaaatcaaagcactagcaaatcacaatgatctggtggtgaaagtaaaagtcctgaaagtattaaccaaactctaatttggagtctgtcccaaacaatattgagatatttgcagttggtacgatgtgatttgtaaattctttgtttttcattgtgcgtatatggtaaagagatcttttcagctgctattttggaataatgactatcatatatcataacagtgactgatgttggttgtaatggttgggtttaggatgaaccattttaaggatgccaaatgaaatattagtatttgtacacagaaagaatttattgatttgatcttattacctagattgagattttttaatctttcctctacctaaactgacaatgaattggttatacatcatgcataagctacacttttatattagtttatatttgttattctaagacttgtgtttcatcaataaagttgtgttttaagcagc

SEQ ID NO: 108842 - DNA, 2663 bp, Homo sapiens
  Payload ID: 1381
  Gene Symbol: ARMCX2
  Gene Name: armadillo repeat containing, X-linked 2
  Uniprot ID: Q7L311
  ENST ID: ENST00000330154
  CDS Start-End: 356-2254
gaatcatttgacattctgatgtgcaaacacgaaaaggcagttactgagacccttgtcctggatgctgatccatccaccaggctttcattgtctaacgtcgacagtctatatttctgctcttcagtctgtccttaggatgaagctctaactgaactgaagtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgccggcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 108843 - DNA, 2762 bp, Homo sapiens
  Payload ID: 1381
  Gene Symbol: ARMCX2
  Gene Name: armadillo repeat containing, X-linked 2
  Uniprot ID: Q7L311
  ENST ID: ENST00000328766
  CDS Start-End: 455-2353
tgggtaccaactctattgcgcagctcgctgccgtgcgtttaacccaggcgaggaggaggaggagaaaattcccccagattcgggcagacacctccggcccacacagccgttcaccccccgtcttttcagtcctggaaaaggaattcgggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgccggcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaa

SEQ ID NO: 108844 - DNA, 2674 bp, Homo sapiens
  Payload ID: 1381
  Gene Symbol: ARMCX2
  Gene Name: armadillo repeat containing, X-linked 2
  Uniprot ID: Q7L311
  ENST ID: ENST00000356824
  CDS Start-End: 553-2451
gtgggcaaaggtacttaaagccctgaccgtcgttctccgtcctcctctgggtaccaactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgccggcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactg

SEQ ID NO: 108845 - DNA, 821 bp, Homo sapiens
  Payload ID: 1381
  Gene Symbol: ARMCX2
  Gene Name: armadillo repeat containing, X-linked 2
  ENST ID: ENST00000440675
  CDS Start-End: 508-821
actctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggaggttgggaaaggactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgc

SEQ ID NO: 108846 - DNA, 580 bp, Homo sapiens
  Payload ID: 1381
  Gene Symbol: ARMCX2
  Gene Name: armadillo repeat containing, X-linked 2
  ENST ID: ENST00000431597
  CDS Start-End: 393-580
cgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcgggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaat

SEQ ID NO: 108847 - DNA, 854 bp, Homo sapiens
  Payload ID: 1381
  Gene Symbol: ARMCX2
  Gene Name: armadillo repeat containing, X-linked 2
  ENST ID: ENST00000433318
  CDS Start-End: 359-854
acgaaaaggcagttactgagacccttgtcctggatgctgatccatccaccaggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaag

SEQ ID NO: 108848 - DNA, 914 bp, Homo sapiens
  Payload ID: 1381
  Gene Symbol: ARMCX2
  Gene Name: armadillo repeat containing, X-linked 2
  ENST ID: ENST00000413506
  CDS Start-End: 413-914
ctctattgcgcagctcgctgccgtgcgtttaacccaggcgaggaggaggaggagaaaattcccccagattcgggcagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctccca

SEQ ID NO: 108849 - DNA, 758 bp, Homo sapiens
  Payload ID: 1381
  Gene Symbol: ARMCX2
  Gene Name: armadillo repeat containing, X-linked 2
  ENST ID: ENST00000458024
  CDS Start-End: 481-758
tattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagt

SEQ ID NO: 108850 - DNA, 3730 bp, Homo sapiens
  Payload ID: 1382
  Gene Symbol: ARMCX3
  Gene Name: armadillo repeat containing, X-linked 3
  Uniprot ID: Q9UH62
  ENST ID: ENST00000341189
  CDS Start-End: 867-2006
agatctgggactagatttcagaggaaatggtagactttcatagctcgggggaggggaggtggagggagaggctgctgtcccaggagcctagggaaggaagaggcaatttttcataaaagtacaagtggcccatagccccaggggaagatgccgtccctttctggtaatcggtggaagggaaacacaactacaaggtgatgagattatcgaagaagaaagagtaataaggcctggtgtgggggagggaaaggaggggggcgggccctcttctgccgcactgctggtgggaggggaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtga

SEQ ID NO: 108851 - DNA, 3318 bp, Homo sapiens
  Payload ID: 1382
  Gene Symbol: ARMCX3
  Gene Name: armadillo repeat containing, X-linked 3
  Uniprot ID: Q9UH62
  ENST ID: ENST00000537169
  CDS Start-End: 457-1596
tctctcccactcgccgcccgctttccaagacatatgtcccgcttgcagcccatttcgatgctgcgaaacgtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagt

SEQ ID NO: 108852 - DNA, 637 bp, Homo sapiens
  Payload ID: 1382
  Gene Symbol: ARMCX3
  Gene Name: armadillo repeat containing, X-linked 3
  ENST ID: ENST00000479298
  CDS Start-End: 447-637
cgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgaggattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatga

SEQ ID NO: 108853 - DNA, 2051 bp, Homo sapiens
  Payload ID: 1382
  Gene Symbol: ARMCX3
  Gene Name: armadillo repeat containing, X-linked 3
  Uniprot ID: Q9UH62
  ENST ID: ENST00000471229
  CDS Start-End: 547-1686
gaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaa

SEQ ID NO: 108854 - DNA, 973 bp, Homo sapiens
  Payload ID: 1382
  Gene Symbol: ARMCX3
  Gene Name: armadillo repeat containing, X-linked 3
  ENST ID: ENST00000491568
  CDS Start-End: 691-973
acgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacgtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaa

SEQ ID NO: 108855 - DNA, 7424 bp, Homo sapiens
  Payload ID: 1383
  Gene Symbol: ARMCX4
  Gene Name: armadillo repeat containing, X-linked 4
  ENST ID: ENST00000423738
  CDS Start-End: 203-7075
ggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctggcactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtca

SEQ ID NO: 108856 - DNA, 2872 bp, Homo sapiens
  Payload ID: 1383
  Gene Symbol: ARMCX4
  Gene Name: armadillo repeat containing, X-linked 4
  ENST ID: ENST00000445416
  CDS Start-End: 438-593
gtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcagtagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtactgccaagagaagcaagaggagaggagggaactgcctcggatcattacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactaacagaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaactaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaa

SEQ ID NO: 108857 - DNA, 1829 bp, Homo sapiens
  Payload ID: 1383
  Gene Symbol: ARMCX4
  Gene Name: armadillo repeat containing, X-linked 4
  Uniprot ID: Q5H9R4
  ENST ID: ENST00000455331
  CDS Start-End: 236-1282
gtcactcgcatctggctaccagctccccgctgccctgcgctcggcgggctggcatcgggcccggggaaagcggagcagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagaga

SEQ ID NO: 108858 - DNA, 3788 bp, Homo sapiens
  Payload ID: 1383
  Gene Symbol: ARMCX4
  Gene Name: armadillo repeat containing, X-linked 4
  Uniprot ID: Q5H9R4
  ENST ID: ENST00000354842
  CDS Start-End: 217-1263
ctccccgctgccctgcgctcggcgggctggcatcgggcccggggaaagcggagcagtagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaaattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatgggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 108859 - DNA, 5399 bp, Homo sapiens
  Payload ID: 1383
  Gene Symbol: ARMCX4
  Gene Name: armadillo repeat containing, X-linked 4
  Uniprot ID: Q5H9R4
  ENST ID: ENST00000433011
  CDS Start-End: 487-1569
gtcgggaaatggcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttgtgctcagagcatgaaaattttctgctgtctttggaactttgtctacaaacagttagaagatgcagcccaagggctcaccatgggtggcgatgttgaagaacatgaagaccttactgctgatagcaccatcttcaaatttgtggaagcttattagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactggtccagagatctcatgaatttatgtatctactttagggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactaacagaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaaatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 108860 - DNA, 3872 bp, Homo sapiens
  Payload ID: 1383
  Gene Symbol: ARMCX4
  Gene Name: armadillo repeat containing, X-linked 4
  Uniprot ID: Q5H9R4
  ENST ID: ENST00000452188
  CDS Start-End: 265-1347
acgcagccttcgttgcagtcgtcactcgcatctggctaccagctccccgctgccctgcgctcggcgggctggcatcgggcccggggaaagcggagcagtagttcggtgtagcactgtttgcggcgaggagaaaggaaggagaggagaaaactgcactggatcaaggaggttagtgtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactggtccagagatctcatgaatttatgtatctactttagggtgtactgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaaattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatgggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 108861 - DNA, 3170 bp, Homo sapiens
  Payload ID: 1383
  Gene Symbol: ARMCX4
  Gene Name: armadillo repeat containing, X-linked 4
  ENST ID: ENST00000442270
  CDS Start-End: 242-397
actcgcatctggctaccagctccccgctgccctgcgctcggcgggctggcatcgggcccggggaaagcggagcagtagttcggtgtagcactgtttgcggcgaggagaaaggaaggagaggagaaaactgcactggatcaaggaggttagtgtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtactgccaagagaagcaagaggagaggagggaactgcctcggatcattacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaaatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatgggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 108862 - DNA, 2899 bp, Homo sapiens
  Payload ID: 1384
  Gene Symbol: ARMCX5
  Gene Name: armadillo repeat containing, X-linked 5
  Uniprot ID: Q6P1M9
  ENST ID: ENST00000246174
  CDS Start-End: 882-2558
gaacttcgaaagactggaacacttccgcctgtcaggccagaagagatttcctgacaccacagctggaaacccatgtgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaa

SEQ ID NO: 108863 - DNA, 2647 bp, Homo sapiens
  Payload ID: 1384
  Gene Symbol: ARMCX5
  Gene Name: armadillo repeat containing, X-linked 5
  Uniprot ID: Q6P1M9
  ENST ID: ENST00000372742
  CDS Start-End: 636-2312
gctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactgg

SEQ ID NO: 108864 - DNA, 782 bp, Homo sapiens
  Payload ID: 1384
  Gene Symbol: ARMCX5
  Gene Name: armadillo repeat containing, X-linked 5
  ENST ID: ENST00000473968
  CDS Start-End: 760-782
agctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagc

SEQ ID NO: 108865 - DNA, 822 bp, Homo sapiens
  Payload ID: 1384
  Gene Symbol: ARMCX5
  Gene Name: armadillo repeat containing, X-linked 5
  ENST ID: ENST00000479502
  CDS Start-End: 619-822
gcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagg

SEQ ID NO: 108866 - DNA, 859 bp, Homo sapiens
  Payload ID: 1384
  Gene Symbol: ARMCX5
  Gene Name: armadillo repeat containing, X-linked 5
  ENST ID: ENST00000477663
  CDS Start-End: 647-859
tgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatg

SEQ ID NO: 108867 - DNA, 4640 bp, Homo sapiens
  Payload ID: 1384
  Gene Symbol: ARMCX5
  Gene Name: armadillo repeat containing, X-linked 5
  Uniprot ID: Q6P1M9
  ENST ID: ENST00000604957
  CDS Start-End: 2623-4299
actgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtgaacactggatacgcgacctggtcatgggaggcgggcggtgagaaggagagagagatgggtaattggaatggcacacaacaattaaaaaaaaatgatctaccttttgctagcttgatttccatacactcggttcacctcagaccatgcttgggaagaaaaaggttgcagcttctagcagggaaaaggcagactagatgaggaagagagggctacttccacaggcgaggacagttgtctggggagccctgagagggagagaatgtaaaaagaggttgtaaatgtttgataatcaaggctctggatttgaaaagggtctcatgtcttggttactggtctgaccattaataaccacgtctctctctctgtcttttcatttgttctttgggtgtgtatcacgcgtttttatgtgtaaatctgttcctaagtttgcagcactccatgtttctgtaaagatctgtaggggacagcagacctcaaggggagaggagaaggaaaagaaaattggcctggtttgtacagagtgggcagtacttgggaggcagtacttggaggtggtagatggctaagattagagtaggcaggagtgtaagggagcctccagaactctctgccagctttcctaacatgtcctcccttacccgcattatgttgcagaaaatgataggctttgggagagaggaaggaaacataggaacccagatgaaatatggaaataaatacttttcattttttccccagcctccgtggtttgtctaggcatttcgtccctactaacaccactactactaccttgtagggatgtttgagttgtctctgtataggaattgtcagactttgagaatagagcagaggggcttggagatttaggagtgggagaaaaaggggagatagaaaatgtttgccaaacaggtacttatatccagaaagaaactgtgccctaggtgctggtctctaccaaaaacagcctcaactgtctcctgtgtcttcatttattggtctctgtttttgtgaatccctgtaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtaaggaggagaaagttactccagatcagtgcaggttggtatgagtgtggggattgcctgggtagacctgtaggatggagtagtggagagctgcttggctccagcaggggtcaagaaccactaaagggattcctcagcttctcatccagttttcctactccttatgctcctgtttggtgactggaaagaaggctgatggcacttggaagtgtagggagtgggtgaaatgaagggagagagagtttgctaattatctacctctctcacctagcactgaatcaccatattctcctgtctccctgtgctgatcagcatgaggagaaaaaagttggaagagactcaaagccccatttccttcctccacccctaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaa
